US011766461B2

(12) United States Patent
Sonnenburg et al.

(10) Patent No.: US 11,766,461 B2
(45) Date of Patent: Sep. 26, 2023

(54) COMPOSITIONS AND METHODS FOR NUCLEIC ACID EXPRESSION AND PROTEIN SECRETION IN BACTEROIDES

(71) Applicant: The Board of Trustees of the Leland Stanford Junior University, Stanford, CA (US)

(72) Inventors: Justin L. Sonnenburg, Redwood City, CA (US); Weston R. Whitaker, Daly City, CA (US); Elizabeth Stanley, Portola Valley, CA (US)

(73) Assignee: The Board of Trustees of the Stanford Junior, California (CA)

( * ) Notice: Subject to any disclaimer, the term of this patent is extended or adjusted under 35 U.S.C. 154(b) by 1020 days.

(21) Appl. No.: 16/094,694

(22) PCT Filed: Apr. 18, 2017

(86) PCT No.: PCT/US2017/028066
§ 371 (c)(1),
(2) Date: Oct. 18, 2018

(87) PCT Pub. No.: WO2017/184565
PCT Pub. Date: Oct. 26, 2017

(65) Prior Publication Data
US 2022/0160791 A1 May 26, 2022

Related U.S. Application Data

(60) Provisional application No. 62/325,379, filed on Apr. 20, 2016.

(51) Int. Cl.
*A61K 35/74* (2015.01)
*C07K 14/195* (2006.01)
*C12N 9/02* (2006.01)
*C12N 15/52* (2006.01)
*C12N 15/70* (2006.01)
*C12N 15/74* (2006.01)
*C12N 15/90* (2006.01)
*A61K 38/00* (2006.01)

(52) U.S. Cl.
CPC ............ *A61K 35/74* (2013.01); *C07K 14/195* (2013.01); *C12N 9/0069* (2013.01); *C12N 15/52* (2013.01); *C12N 15/70* (2013.01); *C12N 15/74* (2013.01); *C12N 15/90* (2013.01); *C12Y 113/12005* (2013.01); *A61K 38/00* (2013.01); *C07K 2319/00* (2013.01); *C12N 2795/00022* (2013.01); *C12N 2795/10043* (2013.01)

(58) Field of Classification Search
None
See application file for complete search history.

(56) References Cited

U.S. PATENT DOCUMENTS

| | | | |
|---|---|---|---|
| 6,162,632 A | 12/2000 | Maloney et al. |
| 6,261,842 B1 | 7/2001 | Handelsman et al. |
| 6,610,529 B1 | 8/2003 | Curtiss, III et al. |
| 7,008,767 B2 | 3/2006 | Handelsman et al. |
| 7,238,853 B2 | 7/2007 | Kuvshinov et al. |
| 7,871,604 B1 | 1/2011 | Curtiss, III et al. |
| 7,981,651 B2 | 7/2011 | Klaenhammer et al. |
| 7,988,961 B2 | 8/2011 | Farrar et al. |
| 9,192,179 B2 | 11/2015 | Roughead et al. |
| 9,487,764 B2 | 11/2016 | Falb et al. |
| 9,598,697 B2 | 3/2017 | Curtiss, III et al. |
| 9,610,307 B2 | 4/2017 | Berry et al. |
| 9,688,967 B2 | 6/2017 | Falb et al. |
| 2002/0019043 A1 | 2/2002 | Steidler et al. |
| 2002/0045177 A1 | 4/2002 | Handelsman et al. |
| 2003/0027286 A1 | 2/2003 | Haselbeck et al. |
| 2004/0025200 A1 | 2/2004 | Kuvshinov et al. |

(Continued)

FOREIGN PATENT DOCUMENTS

| | | |
|---|---|---|
| EP | 1841875 B1 | 1/2006 |
| EP | 3181682 A1 | 9/2009 |

(Continued)

OTHER PUBLICATIONS

Thorson, M., Master of Science Thesis Virginia Polytechnic Institute and State University, "Characterization of the structure and function of a Bacteroides thetaiotaomicron 16S rRNA promoter", pp. 1-91. (Jun. 2003).*

Hamady, et al., "Treatment of Colitis with a Commensal Gut Bacterium Engineered to Secrete Human TGF-βI Under the Control of Dietary Xylan"; Inflamm Bowel Dis; vol. 17, No. 9; Sep. 2011; pp. 1925-1935.

Bayley, Douglas P. et al. (2000) "Analysis of cepA and other Bacteroides fragilis genes reveals a unique promoter structure," FEMS Microbiology Letters 193, 149-154.

(Continued)

Primary Examiner — Anand U Desai
(74) Attorney, Agent, or Firm — Kyle A. Gurley; Bozicevic, Field & Francis LLP

(57) ABSTRACT

Provided are nucleic acids that include a promoter, where the promoter is operable in a *Bacteroides* cell and is operably linked to a heterologous nucleotide sequence of interest. Also provided are nucleic acids that include a promoter (operable in a prokaryotic cell such as a *Bacteroides* cell) operably linked to a sequence encoding a synthetic ribosomal binding site (RBS). Also provided are fusion proteins (and nucleic acids encoding them) in which a secreted *Bacteroides* polypeptide is fused to a heterologous polypeptide of interest. Also provided are prokaryotic cells (e.g., *E. coli*, a *Bacteroides* cell, and the like) that include one or more nucleic acids such as those described above. Also provided are methods of expression in a prokaryotic cell, methods of detectably labeling a *Bacteroides* cell in an animal's gut, and methods of delivering a protein to an individual's gut.

79 Claims, 32 Drawing Sheets
(18 of 32 Drawing Sheet(s) Filed in Color)
Specification includes a Sequence Listing.

(56) References Cited

U.S. PATENT DOCUMENTS

| | | |
|---|---|---|
| 2004/0096938 A1 | 5/2004 | Xu et al. |
| 2005/0276788 A1 | 12/2005 | Steidler et al. |
| 2008/0131402 A1 | 6/2008 | Farrar et al. |
| 2010/0076057 A1 | 3/2010 | Sontheimer et al. |
| 2011/0251156 A1 | 10/2011 | Shen et al. |
| 2011/0287048 A1 | 11/2011 | Round et al. |
| 2013/0109098 A1 | 5/2013 | Allnutt et al. |
| 2015/0004705 A1 | 1/2015 | Lu et al. |
| 2015/0064138 A1 | 3/2015 | Lu et al. |
| 2015/0087055 A1 | 3/2015 | Sarpeshkar et al. |
| 2016/0000837 A1 | 1/2016 | Rey et al. |
| 2016/0030494 A1 | 2/2016 | Henn et al. |
| 2016/0120915 A1 | 5/2016 | Blaser et al. |
| 2016/0199424 A1 | 7/2016 | Berry et al. |
| 2016/0206666 A1 | 7/2016 | Falb et al. |
| 2016/0208227 A1 | 7/2016 | Boeke et al. |
| 2016/0271188 A1 | 9/2016 | Berry et al. |
| 2016/0317414 A1 | 11/2016 | Stettler et al. |
| 2017/0058282 A1 | 3/2017 | Lu et al. |
| 2017/0067065 A1 | 3/2017 | Falb et al. |
| 2017/0128499 A1 | 5/2017 | Falb et al. |
| 2017/0145061 A1 | 5/2017 | Lu et al. |
| 2017/0204401 A1 | 7/2017 | Brevnova et al. |
| 2017/0273997 A1 | 9/2017 | Sakwinska et al. |
| 2017/0306338 A1 | 10/2017 | Curtiss, III et al. |
| 2018/0015130 A1 | 1/2018 | Berry et al. |

FOREIGN PATENT DOCUMENTS

| | | |
|---|---|---|
| EP | 2994537 A2 | 3/2016 |
| EP | 3213265 A1 | 9/2017 |
| WO | WO 2006079790 A2 | 8/2006 |
| WO | WO 2008084115 A2 | 7/2008 |
| WO | WO 2014006146 A1 | 1/2014 |
| WO | WO 2014209792 A1 | 12/2014 |
| WO | WO/2015003001 A1 | 1/2015 |
| WO | WO/2015148680 A1 | 10/2015 |
| WO | WO2016/201174 A2 | 12/2016 |
| WO | WO/2016191757 A1 | 12/2016 |
| WO | WO/2016205394 A1 | 12/2016 |
| WO | WO2017/040719 A1 | 3/2017 |
| WO | WO2017/087811 A1 | 5/2017 |
| WO | WO2017/187190 A1 | 11/2017 |
| WO | WO 2018112194 A1 | 6/2018 |
| WO | WO 2018152133 A1 | 8/2018 |

OTHER PUBLICATIONS

Chen, David J. et al. (2010) "Delivery of foreign antigens by engineered outer membrane vesicle vaccines," *PNAS* 107(7):3099-3104.

Chen, Shicheng et al. (2007) "Mutational Analyis of the ompA Promoter from Flavobacterium johnsoniae," *Journal of Bacteriology*, 189(14):5108-5118.

Estrem, Shawn T. (1999) "Bacterial promoter architecture: subsite structure of UP elements and interactions with the carboxy-terminal domain of the RNA polymerase α subunit," Genes & Development 13(66):2134-2147.

Hawkins, Shawn A. et al. (2008) "Genome sequence of the Bacteroides fragilis phage ATCC 51477-B1," *Virology Journal* 5(1):97.

Kim, Jae-Young et al. (2008) "Engineered bacterial outer membrane vesicles with enhanced functionality," *J Mol Biol*. 380(1):51 -66.

Lim, Bentley et al. (2017) "Engineered Regulatory Systems Modulate Gene Expression of Human Commensals in the Gut," *Cell* 169, 547-548.

Mastropaolo, Matthew D. et al. (2009) "Comparison of *Bacteroides thetaiotaomicron* and *Escherichia coli* 16S rRNA gene expression signals," *Microbiology* 155, 2683-2693.

Mimee, Mart et al. (2015) "Programming a Human Commensal Bacterium, Bacteroides thetaiotaomicron, to Sense and Respond to Stimuli in the Murine Gut Microbiota," *Cell Systems* 1, 62-71.

Ogilvie, Lesley A. et al. (2012) "Comparative (Meta)genomic Analysis and Ecological Profiling of Human Gut-Specific Bacteriophage φB124-14," *PLoS One* 7(4), e35053, pp. 1-17.

Parker, Anita C. et al. (2012) "Development of an IPTG Inducible Expression Vector Adapted for *Bacteroides fragilis*," *Plasmid*. 68(2):86-92.

Rawlings, Neil D. et al. (2015) "Twenty years of the MEROPS database of proteolytic enzymes, their substrates and inhibitors," *Nucleic Acids Research*, vol. 44, pp. D33-D350.

Ross, Wilma et al. (1998) "Excherichia coli Promoters with UP Elements of Different Strengths: Modular Structure of Bacterial Promoters," Journal of Bacteriology 180(20:5375-5383.

Shen, Yue et al. (2012) "Outer Membrane Vesicles of a Human Commensal Mediate Immune Regulation and Disease Protection," *Cell Host & Microbe* 12(4):509-520.

Wegmann, Udo et al. (2013) "Defining the *Bacteroides* Ribosomal Binding Site," *Applied and Environmental Microbiology*, pp. 1980-1989.

Whitaker, Weston R. et al. (2017) "Tunable Expression Tools Enable Single-Cell Strain Distinction in the Gut Microbiome," Cell 169, pp. 538-546.

Wilson, Marlena M. et al. (2015) "Analysis of the Outer Membrane Proteome and Secretome of *Bacteroides fragilis* Reveals a Multiplicity of Secretion Mechanisms," *Plos One*, pp. 1-24.

Mimee, M. et al.: "Programming a Human Commensal Bacterium, Bacteroides thetaiotaomicron, to Sense and Respond to Stimuli in the Murine Gut Microbiota", Cell Systems, vol. 1, 2015, pp. 62-71.

Weston R. Whitaker et al: "Tunable Expression Tools Enable Single-Cell Strain Distinction in the Gut Microbiome", Cell, vol. 169, No. 3, Apr. 1, 2017 (Apr. 1, 2017), Amsterdam, NL, pp. 538-546.e12.

\* cited by examiner

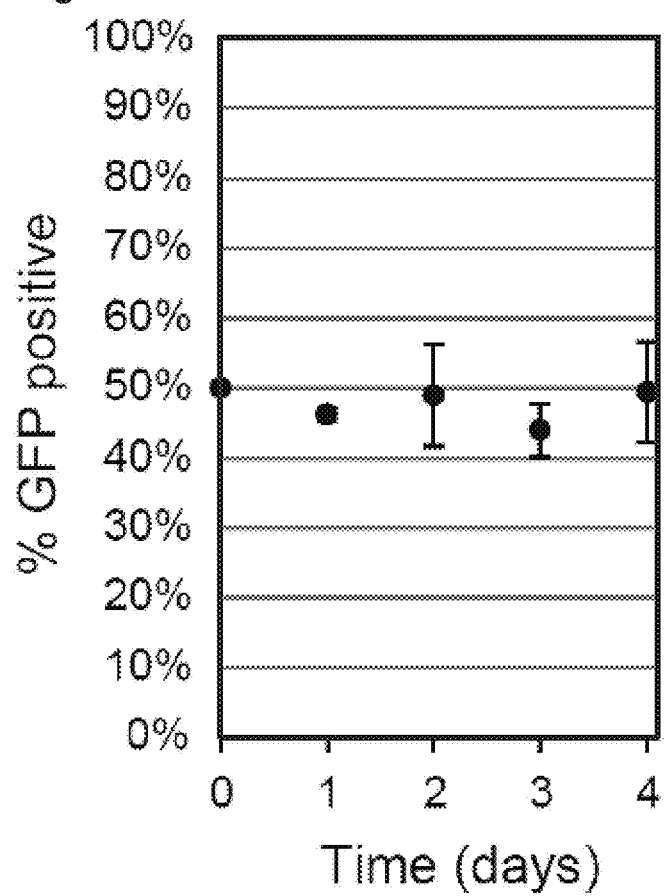

Fig. 15

Table 1. Percentage of correctly assembled, genomically integrated constructs for each species using the high-throughput cloning and conjugation protocol.

| Species | Bt | Bo | Bu | Bv |
|---|---|---|---|---|
| Correctly assembled and integrated | 99.4% | 99.3% | 99.3% | 98.2% |

Table 2. List of oligonucleotides used for RBS libraries.

| Oligo name | Sequence |
|---|---|
| D05.RBS-libN F | GACTgatcNNNNNNNNNNNNNNNNNNNNcgta |
| D06.RBS-libN R | CATTtacgNNNNNNNNNNNNNNNNNNNNgatc |
| D07.RBS-libR F | GACTgatcNNNNNNNNNNNNRRRRRRRNNcgta |
| D08.RBS-libR R | CATTtacgNNYYYYYYYNNNNNNNNNNNgatc |
| D09.RBS-libW F | GACTgatcNNNNNNNNNWWWAAAWWTWANaat |
| D10.RBS-libW R | CATTattNTWAWWTTTWWWNNNNNNNNNgatc |

Fig. 16

Table 3. List of plasmids used. See Supplementary sequences for plasmid sequences.

| Plasmid | Description | Resist. | Figure | Note |
|---|---|---|---|---|
| pWW3056 | NotI/dropout/SbfI | CAM | - | Used for cloning basic parts. |
| pWW3804 | AmpRi-tetQ-R6K- | CAM | - | Basic part. Vector upstream of cassette |
| pWW3805 | AmpRi-ermG-R6K- | CAM | - | Basic part. Vector upstream of cassette |
| pWW3806 | AmpRi-ermG-R6K-P_BfP1E6 | CAM | - | Basic part. Vector upstream of cassette |
| pWW3047 | GFP | CAM | - | Basic part. GFP has a 3xFLAG and His tag. |
| pWW3512 | mCherry | CAM | - | Basic part. |
| pWW3815 | NanoLuc | CAM | - | Basic part. |
| pWW3810 | T-NBU2-AmpRii | CAM | - | Basic part. Vector downstream of cassette |
| pWW3827 | ffGFP3Fs-T-NBU2-AmpRii | CAM | - | Basic part. Vector downstream of cassette |
| pWW3828 | mCherry-T-NBU2-AmpRii | CAM | - | Basic part. Vector downstream of cassette |
| pWW3840 | NanoLuc-T-NBU2-AmpRii | CAM | - | Basic part. Vector downstream of cassette |
| pWW3852 | P_BfP3E1 | CAM | - | Basic part. Promoter |
| pWW3853 | P_BfP2E2 | CAM | - | Basic part. Promoter |
| pWW3818 | P_BfP2E3 | CAM | - | Basic part. Promoter |
| pWW3820 | P_BfP1E4 | CAM | - | Basic part. Promoter |
| pWW3821 | P_BfP5E4 | CAM | - | Basic part. Promoter |
| pWW3822 | P_BfP2E5 | CAM | - | Basic part. Promoter |
| pWW3823 | P_BfP4E5 | CAM | - | Basic part. Promoter |
| pWW3865 | P_BfP1E6 | CAM | - | Basic part. Promoter |
| pWW3533 | AmpR-ermG-R6K-{P_rRNA-RBSlibWhit-GFP-T}-NBU2 | AMP | 2a | Assembled construct |
| pWW3541 | AmpR-ermG-R6K-{P_BT4615-RBSlibWhit-GFP-T}-NBU2 | AMP | 2a | Assembled construct |
| pWW3542 | AmpR-ermG-R6K-{P_BT2029-RBSlibWhit-GFP-T}-NBU2 | AMP | 2a | Assembled construct |
| pWW3543 | AmpR-ermG-R6K-{P_BT1830-RBSlibWhit-GFP-T}-NBU2 | AMP | 2a | Assembled construct |
| pWW3544 | AmpR-ermG-R6K-{P_BT2723-RBSlibWhit-GFP-T}-NBU2 | AMP | 2a | Assembled construct |
| pWW3545 | AmpR-ermG-R6K-{P_BT2740-RBSlibWhit-GFP-T}-NBU2 | AMP | 2a | Assembled construct |
| pWW3834 | AmpR-ermG-R6K-{P_BT1311-RBSlibWhit-GFP-T}-NBU2 | AMP | 2a | Assembled construct |
| pWW3837 | AmpR-ermG-R6K-{P_BfP1E6-RBSlibWhit-GFP-T}-NBU2 | AMP | 2a | Assembled construct |
| pWW3866 | AmpR-ermG-R6K-{P_rRNA-RBSphage-GFP-T}-NBU2 | AMP | 2a | Assembled construct |
| pWW3867 | AmpR-ermG-R6K-{P_BT1311-RBSphage-GFP-T}-NBU2 | AMP | 2a | Assembled construct |
| pWW3868 | AmpR-ermG-R6K-{P_BT1830-RBSphage-GFP-T}-NBU2 | AMP | 2a | Assembled construct |
| pWW3869 | AmpR-ermG-R6K-{P_BT2029-RBSphage-GFP-T}-NBU2 | AMP | 2a | Assembled construct |
| pWW3870 | AmpR-ermG-R6K-{P_BT2723-RBSphage-GFP-T}-NBU2 | AMP | 2a | Assembled construct |
| pWW3871 | AmpR-ermG-R6K-{P_BT2740-RBSphage-GFP-T}-NBU2 | AMP | 2a | Assembled construct |
| pWW3872 | AmpR-ermG-R6K-{P_BT4615-RBSphage-GFP-T}-NBU2 | AMP | 2a | Assembled construct |
| pWW3351 | AmpR-ermG-R6K-{P_BfP1E6s-RBSlp-LP-GFP-T2}-NBU2 | AMP | 2b, 2c, S4-7 | Assembled construct |
| pWW3855 | AmpR-ermG-R6K-{P_BfP3E1-RBS8-NanoLuc-T}-NBU2 | AMP | 2e | Assembled construct |
| pWW3856 | AmpR-ermG-R6K-{P_BfP2E2-RBS8-NanoLuc-T}-NBU2 | AMP | 2e | Assembled construct |
| pWW3857 | AmpR-ermG-R6K-{P_BfP2E3-RBS8-NanoLuc-T}-NBU2 | AMP | 2e | Assembled construct |
| pWW3858 | AmpR-ermG-R6K-{P_BfP1E4-RBS8-NanoLuc-T}-NBU2 | AMP | 2e | Assembled construct |
| pWW3859 | AmpR-ermG-R6K-{P_BfP5E4-RBS8-NanoLuc-T}-NBU2 | AMP | 2e | Assembled construct |
| pWW3860 | AmpR-ermG-R6K-{P_BfP2E5-RBS8-NanoLuc-T}-NBU2 | AMP | 2e | Assembled construct |
| pWW3861 | AmpR-ermG-R6K-{P_BfP3E5-RBS8-NanoLuc-T}-NBU2 | AMP | 2e | Assembled construct |
| pWW3864 | AmpR-ermG-R6K-{P_BfP1E6-RBS8-NanoLuc-T}-NBU2 | AMP | 2e, 2f | Assembled construct |
| pWW3880 | AmpR-ermG-R6K-{P_BfP1E6-RBS1-NanoLuc-T}-NBU2 | AMP | 2f | Assembled construct |
| pWW3881 | AmpR-ermG-R6K-{P_BfP1E6-RBS2-NanoLuc-T}-NBU2 | AMP | 2f | Assembled construct |
| pWW3901 | AmpR-ermG-R6K-{P_BfP1E6-RBS3-NanoLuc-T}-NBU2 | AMP | 2f | Assembled construct |
| pWW3902 | AmpR-ermG-R6K-{P_BfP1E6-RBS4-NanoLuc-T}-NBU2 | AMP | 2f | Assembled construct |
| pWW3903 | AmpR-ermG-R6K-{P_BfP1E6-RBS5-NanoLuc-T}-NBU2 | AMP | 2f | Assembled construct |
| pWW3904 | AmpR-ermG-R6K-{P_BfP1E6-RBS6-NanoLuc-T}-NBU2 | AMP | 2f | Assembled construct |
| pWW3905 | AmpR-ermG-R6K-{P_BfP1E6-RBS7-NanoLuc-T}-NBU2 | AMP | 2f | Assembled construct |
| pWW3452 | AmpR-ermG-R6K-{P_BfP1E6-RBSlp-LP-GFP-T}-NBU2 | AMP | 3b-f, S10-11 | Assembled construct |
| pWW3515 | AmpR-ermG-R6K{P_BfP1E6-RBSlp-LP-mCherry-T}NBU2 | AMP | 3b-f, S10-11 | Assembled construct |
| pWW3534 | AmpR-ermG-R6K-{P_BfP1E6-RBSlp-LP-GFP-T}-{P_BfP1E6-RBSlp-LP-mCherry-T}-NBU2 | AMP | 3b-f, S10-11 | Assembled construct. 2 cassettes |
| pWW3535 | AmpR-ermG-R6K-{P_BfP1E6-RBSlp-LP-GFP-T}-{P_BfP1E6-RBSlp-LP-mCherry-T}-NBU2 | AMP | 3b-f, S10-11 | Assembled construct. 2 cassettes |
| pWW3536 | AmpR-ermG-R6K-{P_BfP1E5-RBSlp-LP-GFP-T}-NBU2 | AMP | 3b-f, S10-11 | Assembled construct |

Fig. 17a  *B. theta* proteomics *in vitro*
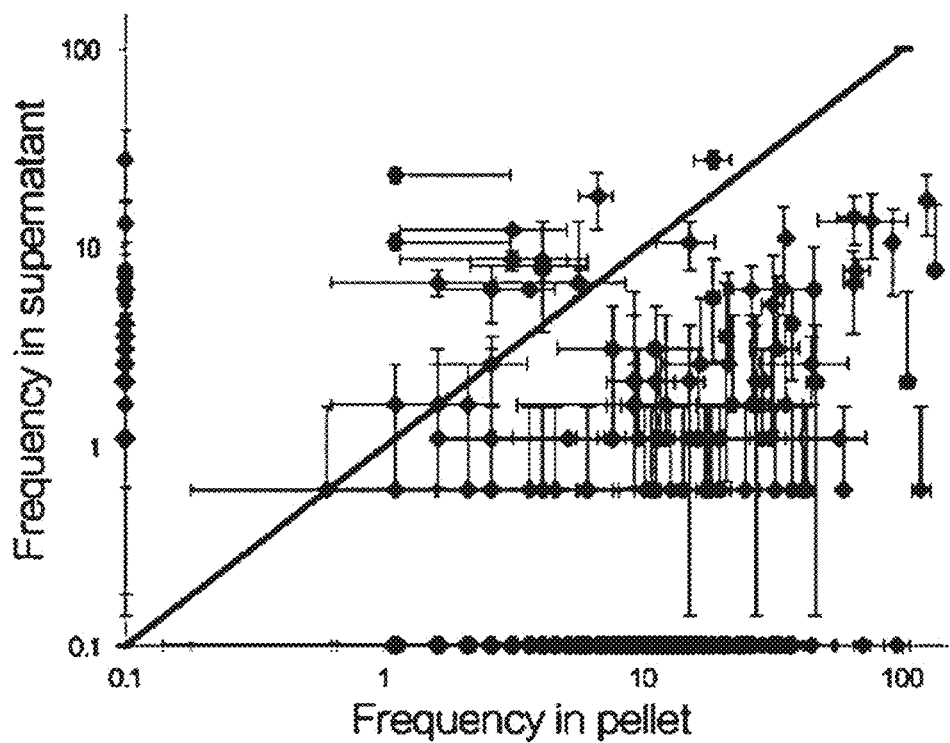
Fig. 17b
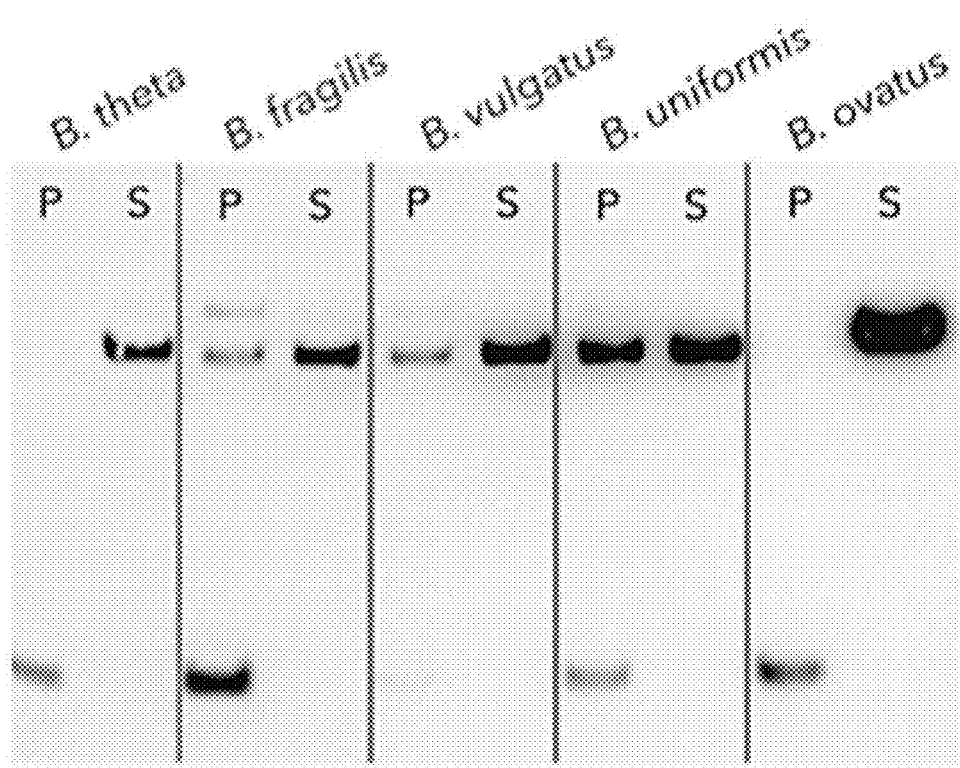

Fig. 19

>BT0344 (SEQ ID NO: 458)
MKTIKQIVFCVSLLLVMNCFYSCSNSNDVVINTQQNQEKTQDVEIQELIDFIETLNANKIQT
RGPFWNRIKRFLVGDAWGYGWGVNKGLTPRGGLITAVVFSLICAASDDDLPRNWWHLS
SNWKVYDAPLRPYEIIGNDHNKTIYNMMREDPVIANGTFSNYYLYNSTNKKLKSYGYTEE
MPLLLQTRLLEIMDLVKKSTSVDQLMNLMKQEFPQRVSEFQLVESYINGLVNMDDKSTVR
DYTKQVYAQIDASSLDVSAVSRLKTMIAIAENSKFLWVETK

> BT0525 (SEQ ID NO: 459)
MMKKTILLTSIIAIAIVSMLSSCVDSEKDLYDPSYQTANPMGDGFAAPDGFDWNMTTTSIL
NIEIDDELYNQIEILDANPFSTSDYHILAKGVAKKGQAFSQEINYTEGTNYLYIRKTDSRSRV
SISTWDVSKNKEFVGSRTTRVAKATIGSYNIPEKYPEETYDTTGAIELTGNTNWNQSNHH
LEAGKSYIIKNKFNGEINHTSGYLNGGRFTIFVEGEWTPSQNQIQSADIIILKGGKINTDSFT
SFLIADNSILTIQSGGSLIGNNINLAAIGVLLKNFGTISVNSMKDLNTTSILYNAPKATINVTGK
SVASWEQSVFTKGAIYNFGELTIQEGALKFNSQDATCYFYNGTEATINTPTFIIGGIGVNDG
TVNAQKISNDNGGNPTFTNNCSLYAQNSFEFGGTSGTIIMNKGILAGGVENGTFIAIPSFK
CGNSGSTFELNNGSMIKAEIMDIPNVTFKAAGTRSLIKSTKSISTGWTTKFNGNLDIECPE
GEFAKGVPANNPNYIMENSVELYIPNGSKTIITSCGELSEIPDPTPDPEDPEFPIEVEDNKD
YTYLFEDQWPLYGDYDMNDIVLTIQKRKIYTNKENKVTKFELSIDLSAAGATKSIGAAIMLD
NVPANAITQSVEFSDNTLAKNFNLNNNNIESGQDYAVIPLFDDAHKVLGRDRYEQINTVSD
YAGNTKPKNISFSITFNNPTISADAFNVNNLNVFIIVDGNRNPRKEIHVAGYQPTKLANTDL
FGGNNDNSHHGSKKYYISKENLAWGIMVPSNFKWPLEYVNIKTAYSQFSDWVTSGGTEN
EKWWNDFDVNKVFQTNKN

> BT0586 (SEQ ID NO: 460)
MFFLAGICAALAACSSDSDDVSSSPSNTPAILEVVSYKFVQEETDVVERVEYPVVVLQHK
VNDKDEPLPMIYAWDVEEEENSLFVLTEGSLPVNAENLADLKIPVPFIDAGGKLFIDGTGA
KTPLIFGETLKVKNGSRSIGNVKYKIPPYSTYELTKQECGYRCTLTFYLVLKAVNKGEEYHL
KGRWTGEQLREQKMGLIDLSDEKGAEKTVLMEAPIELFEKDYETGLD

> BT1760 (SEQ ID NO: 461)
MMKNMILPIAFTALIASMTACSDETDPILTQKNWDGTATYFQSSDEHGFSMYYKPQVGFV
GDPMPFYDPVAKDFKVMYLQDYRPNPEATYHPIFGVATKDGATYESLGELISCGGRDEQ
DAAIGTGGTIYNPADKLYYTFYTGNKFKPSSDQNAQVVMVATSPDFKTWTKNRTFYLKG
DTYGYDKNDFRDPFLFQTEDGVYHMLIATRKNGKGHIAEFTSADLKEWESAGTFMTMM
WDRFYECPDVFKMGDWWYLIYSEQASFMRKVQYFKGRTLEDLKATTANDAGIWPDNRE
GMLDSRAFYAGKTASDGTNRYIWGWCPTRAGNDNGNVGDVEPEWAGNLVAQRLIQHE
DGTLTLGVPDAIDRKYTSAQEVKVMAKDGNMIESGKTYTLGEGASVIFNRLKVHNKISFTV
KTASNTDRFGISFVRGTDSASWYSIHVNADEGKANFEKDGDDAKYLFDNKFNIPADNEYR
VTIYSDQSVCVTYINDQLSFTNRIYQMQKNPWSLCCYKGEITVSDVQVSTY

Fig. 19 (Cont.)

> BT1762 (SEQ ID NO: 462)
MKKIIYIATIGITLLTTSCDDFLDRQVPQGIVTGDQIASPEYVDNLVISAYAIWATGDDINSSF
SLWNYDVRSDDCYKGGSGTEDGGVFNALEISKGINTTDWNINDIWKRLYQCITRANTALQ
SLDQMDEKTYPLKNQRIAEMRFLRGHAHFMLKQLFKKIVIVNDENMEPDAYNELSNTTYT
NDEQWQKIADDFQFAYDNLPEVQIEKGRPAQAAAAAYLAKTYLKAYRQDGADNALTGI
NEEDLKQVVKYTDPLIMAKGGYGLETDYSMNFLPQYENGAESVWAIQYSINDGTYNGNL
NWGMGLTTPQILGCCDFHKPSQNLVNAFKTDSQGKPLFSTYDNENYEVATDNVDPRLFH
TVGMPGFPYKYNEGYIIQKNDDWSRSKGLYGYYVSLKENVDPDCDCLKKGSYWASSLN
HIVIRYADVLLMRAEALIQLNDGRITDAISLINEVRSRAAGSTMLIFNYKEDYGVNFKVTPYD
LKAYAQDEAMKMLKWERRVEFGMESSRFFDLVRWGEAKDVINAYYVTEASRCSIYKNA
GFTENKNEYLPVPFEQISASNGNYTQNFGW

> BT1826 (SEQ ID NO: 463)
MKRKFVKVMFFGALALSTVTYVGCKDYDDDIKNVQEQIDAINKKGADVTTEAMTAAINSA
VAGLQTQLDAIASKADKTALDELKKTVTDLQAALNNKADAIKLTELQTKLDEAIAKVNASIE
SSVGAAKTELQAKIDKLQADLEKADADAAEKIATELAAVKTELQGLINANGEKIADLYEKIK
GLDAIKTKIEALEEADKNFVTISQLNDYMNSEAVKAYVDEALVDYLTSAEVTEQVNAVKTY
VDGTFKAAIMAEIKAEYLSLEKYNADMEALMEKIDTYVGKEDAAYKKIFTDITALQTYQQQT
IEVLVASLAENNTIENANKIVGALEDITTLQTEIAKCAKTTDLDAYVKGTELGGLIDTHLQDK
FAGYDGEIADIKKRLLALEIDVDGLKSMVQSVTFVPSDSEGKVYFSSYYVVSEGETEKTLIA
SNNTVTVKFRVSPVSAAKNFFDNYTASFDAQEITTRAANIFEGEGKVENADEGIISFVISTT
TEQSHAVCLNIIAKNSVPENAETAIKGTDYFTNINSNYFPVIVTTKTISGIQVESTNSTVSSIY
YNKEASKIDYKAGVALKARFVDGGNATLDPENVDLSNLVTSYEFDKDMTNPDAPVILDGD
GSYKLEDGVLSLKNYAAESAGKEATVVAYVAVKDGDNTLKEFKSTAYAKVTAANYTDGT
VNLTPVAPTDVLYDGTKVTSTSAYALTELYTSAGSKDIYEAIPVDKFTPTADKGVTFVIGEK
NALTINVPKGTAAGTYSPTLKIQVDAVKVINVSASVKVSYQDIKVVIDGNIVSAGAMTLKPT
YQGSYEKPTSVGFTLDLATLYTNYATQLAAVKKVGGDITLTLKDAVKGASINGTTLTVDKT
YNAHADDINPIVIVAKTVYGEATLDNSTVETKINLTEISGTWAFTIKSAAFGKDNLNSTLNIA
KTASWTDYRGKVMWADGAEKAQGTTEWGAKPLSVYGFTAPVFSIATADADKAKYVNITT
DGKISLTDAGKNLASAITLKVNVAAVSNWGTITDFASNNEVTVKIDLSQDAADI

> BT1896 (SEQ ID NO: 464)
MMTGLTLLSCSTENDEFKKELPPTEQPSEPTGALLERFSIDQLPAKTIYALGESIDLTGLKV
TGEYDDGKQRSVNVAPKQISGFSSSVPVDKQEVTITIEGKQKSFTIQVAPVRVENGVLTE
VLKGYDEIILPNSVKSIPKNAFNGSKINKVTLNEGLKSIGDMAFFNSTIQEVIFPSTLEQLEE
NIFYYCYHLKKADLSRTKLTKLPASTFVYAGVEEVLLPATLTEIDAQAFLKTSQLKTIEIPEN
VRTIGLEAFRESSITTVKLPNGVTNIAQRAFYYCPELTEVTTYGTVFNDDPEAMIHPYCLEG
CPQLTRFEIPQSIRILGQGLLGGNRKVTQLTIPANVTQINFSAFNNTGIKEVKVEGITPPQVF
EKIWYGFPDDITVIRVPAESVEKYKTAAGWQDYTNKIQAS

Fig. 19 (Cont. 2)

> BT1938 (SEQ ID NO: 465)
MSGTAEVNPITVDVYLDITVENISTLKDLTVKFDNYDEDLHYVKEVTDNSVKVDGIIPGIYSV
TVSGTAIDTENNEYYINGNSVNAALFKHGSALNIEVQGLKVSPLIFKEIYYCGSRPEKGGV
YFRDQFYEIYNNSADILYLDGIYFANLTPGTATTKLPIWPEADGNNYAYGERVWKFPGNG
TEYPLAPGESCIISQFAANHQLDIYNPQSPIDGSSSEFEFNMNNPNFPDQAAYDMQHVFY
QGKAEMGSIPQYLTSVFGGAYVIFRVPEGEAWDPVNDENMKTTDLSKPNSNVYYAKIPIK
YVLDAVEAVNNESKMNAKRVPGVLDAGITWVGATYCGLGIARKLSTDEEGNPIIREETGT
YIYQDTNNSTDDFERGVVPVMRRNGAKMPSWNHTL

> BT2170 (SEQ ID NO: 466)
MKKFNDANVGLFVLLTACLSLFSCNNDNDNYPKDYVGFEKSTRTVECDKNQSESELQIKII
ATDKSKEDRTVLLATPALPAGQAPIMKLTETKVTIKAGQKSATTTIKLYPKKMVLKQQNITL
SCTPQWKEGSVSKLTILLKRN

> BT2239 (SEQ ID NO: 467)
MKKIQYVKLVGLLTILLFLNISCKDDDTLLRGSGITEQSWSTNQTYFASAEQTLTFTFTTLS
SWTAQNSSTALLSLDNTAGNSGENTIKVTVHKSSQEQGTITIKVNGYSSASNIKIQLSDDD
VQGYEINYSVDQYLREKYLWNDDYKLLTPNFRQAYDEFLRNTLLSMTTNTLDKKRNSNG
TYSLFSFIQKLDPDLQTSRSAKEKKTLEYNYGFVNFIAVGNRNNSNYGLVIQGVHKGSSA
DKEGLKRGMEITEIDNQRITTTNVQACYSKLIKPSSPTSIKVKDKDGKVYTINSGPIYANPII
HHQVNEKIGYLVYSAFESGFDQELFDVFKEFKSQNITELILDLRYNGGGDVTSANLISSCIA
GDLCIDKTFASYRYNDERMKVLGNQRPIQKFAYSQYDNLSTSLSAGGLNLRKIYCLVTDD
SASASELVINALRGIDIEVILIGTTTHGKNVGMEGVELTAGTDKYLLFPITFQAYNAKGFGDF
ENGFTPDYEINENKPNGEYFEGYGDFGAESDPLYAKAISLISGNEVTTPTRAVNQAKEQM
LVIATPRLNRIGMIK

> BT2263 (SEQ ID NO: 468)
MKKILLYASLATTALFAGCDLNINDDPNYPMNDQVTADLIFPSISASIASAVGGEIYNYAGF
FAQYYEQKPESNQYNTLCEYTFTESSQQMDYSYRILFAGALEDAKQVLEKTTNPADRFAT
TILRAYAFQIMVDNTSDSPYSEALQGNANATPKWDTGETVYKGILGEIDAAEAALDGSGM
DVPDLIFNKNIAQWKGFANALRLRMYLRFIDANIDAASYTEKVKTLVQNNEFFTGDVKLDC
FLDETDKRNPWYNTNAVGLTGNHCAAYPLVSYLSSTGDPRIAYGISKTDADGKYVGQLP
GGKTHMQSILGTDNWKNKNVSAIDYSIGATKPVYFTQAELQFLIAEVYARFHNDDANAK
SAYEAGVTADFAVRGFAGQENTILEGACAWSAASTQADKLNLIYMQKWVSLFYMDHMEA
WSEIRRTDCPKLSSYSAAQIQASESVYTPGELVAPWTNGLEAGGLMKRMTYPLSARQQN
VNTPAGVPGSTPVWWDIK

> BT2317 (SEQ ID NO: 469)
MFYCMKKNLLFAAMAVTALASCSNDDVVDVNNGGGISFRASLDRAVTRTNVTSLQNLAA
FNVTAIGDGKNYFTDLGVSSADNGVNWTTASTYYWPGYELAFFAYAPQAPAGTVSIDNA
SKKITGFSPAQAVADQKDLVISYNTGTKAVNEGPGVAMNFKHALSQIEVKAKCSNDKIKIEI
MGVKLVNAAAKAEFAFPETETKSSYVLQQSQWSNWSEKDDPTKAYMIKGGAPVILTADA
QRIMFGDDNFMLIPQQLTAWDGTTATTGAYLSVLCRIYSLDGANEILLYPQPAAGDAKDG
KYAFSAVGINTNWEPGKKYTYTLNFCGNGGGTGEIDPNPTDPTNPTDPTIDPDVPGGN
GGDPVLGNPIKFTVTVDEWTDQPVDVAM

Fig. 19 (Cont. 3)

> BT2451 (SEQ ID NO: 470)
MKQHAHLLILTIMFLTSCSDDTEVMKQESSPPSLTEKAPTYRTKENAIIEVELFIKNNRNNT
RNSSFLNYSINNEIYFYRDTITNQTYPSFYIANAEGGNGYAIVSANLYTTPIIAYSESGNLSL
SDTLQYQELSFFFDLVQNYISNNKKYEIEFKEENDDDNSLDTSQTRGRRRPIYIKKPGEWE
ETERVQPLISVKWGQRSPYNNAAPLIEGQRALTGCVATAIAQVMAYHEKPSGYNGVSYN
WSEMKQFPTTPAVAHLFRSIGDLVKMDWGTDTSGAKRKNIPQCFEKMGYRKPNNPQIYS
QWDVITSIKAKCPVIICGNSVRKKILGIKYYQNGHAWVSDGYFHRERNVDVYRKGSDKVH
HSYTEKEDYLHLNWGWNGNSNGYYLAGIFNGGEGPTFPSTRAAGKGNYPYNVEIIPYINII
K

> BT3066 (SEQ ID NO: 471)
MIFHRIFRFTYFLIFCIWGLQSCTKDDLIETPADTDSETTENPYGIIRIAEKDLTPDVFKLMLQ
DDEPATILFNNTQRGFRVNQPLQVSITEQQELFIRFYSPRPVKEVTVWATISGYEEAFQLA
KFDVLPAFTEFHKELPMLTQSKRYITRSGKEIQIMANPHLSAADFKLEIECNDKYYQKLLST
KSKYNVRFSAYSQTGSWAYPLYPAHAREAVAMMLNYGYMFSSKEFAEELEKYRGKLHS
DANKTVIDIDMLLKKVINHSGFVIGKVTTVDGLGGGETYGLNEWCFLEHYADDGAHTSAT
FHELGHCLGYGHSGNMTYEQTGTGWITLCATVYNKLCIEKKLPVYSRRFMHTRRYGKLY
GSSKYNASRYIIEDPELDAIDGGLSPILKEEDEDTAQGTPLSCIITYKDIPQATESTFAPKDV
CVYGNRIYIVNNASGNFSLEILEEQNGKLTHIKSLKEWTEGGATKGFAATPNGVTVAHGKI
YVTNEQSRTDIFDEKTFELVATIGTGSWGEGSNQTVHAFDVLVHRGCVFIRDKKRVCVFI
EDDIVPGKSFKNVPNYCRTSNMGEAMGTYGQTIGNDGLLYTTHQGNKKIYVFDLQAMRE
QVEWKAQRVINLTSYSPYDIAFIGKRMFVSFATGKNQPIALAEVNPETGTVIKDYTTVEGH
TFSNVEKMSMARQTLFIVDRNAHTVTGIPVEKLN

> BT3274 (SEQ ID NO: 472)
MFLLIITSCYEDKGNYDYREMNDIEISVETESSSYALGDKVTSKPKLVFTLGKESSDLSYE
WTFDGHVIADTRDLEWVADTIASTKELRLAVMDNNTGVTYFGSTYISVSSAYASNGWVVL
SEKEGISTLAFLREQTEEGILKPVVTRDIYQMINGVPMGTQPVSMYPHWTERWDGEDKT
SWLWVAQKGGQGAVDISGSSYKQEGILSQMFLSKSYPEGFVPVGVIDMQFLTMAIGEDG
TIYTRVKDSNLLFNSSNFLDRPLTSDEEGKVKVDGSMIAYAPFDEHGGMVLYDKNSSQYL
HIADYKSWQGYNYSGKVLPLKVEEYEYGPSDARLDNMKDYSVYFVGASLVDWGDVSYM
SIIKDKAGRFYIQKFTVEAYGGGSSVTKVGASFTSQSEIEGLSSVIDGTSKNCFYLCRNQD
KAPYLFISKGETLYFYYTDGNKIYTCAQFDSPITSIDAECFNNKYIIVGLENGDVYILKGDDD
NSDYTLKKYVIQQNKVIQVNDAENKFVLFHEKDFGRIIQVRYKWKESWNESFS

> BT3521 (SEQ ID NO: 473)
MMKQYIFSALCLVSGAFCLSSCNDDKEARPYTPDYEIVPEYTNADTWKAYEAFNEHLLDQ
NKFIYKSSTADKAAVDRWNGAAAIWCQPTYWDMAMNAYKRAKAEGDTQKEQKFKQLCD
DLFAGNKAHYANFDFDDNNENTGWFIYDDIMWWTVTLARAYELFGVEEYLSLSEESFGR
VWYGSEKVGDTGSYADPEKGLGGGMFWQWQPIKNPNPNEADHGKMACINFPTVVAAL
TLYNNVPTGRTESTDSHPSYQTKEQYLAKGKEIYAWAVENLVDVTTGQVADSRHGNGNP
AWKDHVYNQASYIGASVLLYKATGEKQYLDNAVMAADYTMNTISGTFDLLPFETGAEQGI
YTAVFAQYIAMLVYDCDQTQYIPFVKRNINYGWANRDKTRDICGGDYTKLQVEGDAVESY
SASGIPALMLLFPTDK

Fig. 19 (Cont. 4)

> BT3540 (SEQ ID NO: 474)
MITKKKYTLYYVMALACGLVASFFIYSCSADGYYSEEIEKNEVTNTRALSSKMINNGSTLI
DSIASSDEFWEFEMSSELLADKFHEYTSILSEEEYDKLMENLNDDDYVEDFMRKANLENE
LQQLAKAKENLIKHTRFLRLSADERTQLFILYAESNELTKVKLLKTREEGGSTSSCEEQKQ
AAYKQAKADYDNAIANCQNGSMPSGCLIQAAAKYDRAKDIANKEYKECIANK

> BT3594 (SEQ ID NO: 475)
MKQIIFIAILLTCAFGACSSDNDGDEQSASVQAPSDITIERMGKTKVLLRWKDNSNNETGF
SILLRKADTSENIEIAKVSANVTEYTIENGLEEGNIYYFGVRAFSATNTSRAIYELYRLVALG
DEPSIAIIGSIKANSTCISSSYQVTNIAGQTNVKYGLCWSTENTPTINDQKQNGPEVAEDGK
VFQVIPNTLLDYGKSYKVRAFLTTSTGTYYSAESTVSLETEPQAIQLTWNKLTKSTLPAEIE
LYETTSNLNGSNFHAWYAIGDLSTGKVEVRVHIPSSPATIDTQSASFNGDCYLLVNGGYF
YNGNHTGIAVINSIKSGSVSAVRGSLKTGDTEYNSMYNVTRGTFGVDASGKPNVVWTGT
DASSNVFYFDRPLPSVKGENKYGIVTNENPTTAISWSPKYALSAGPVLLKDKKIPFDFTET
SKGTDYYLSNYEIIPYDIFGANVTPDRTAIGYREDGKVVIFICDGRITASGGATLTELAQIMK
GLGCVGAINLDGGGSTGMVVGDEHLNDMTGGNRAVVSTIGFFKKN

> BT3740 (SEQ ID NO: 476)
MNYSCRKTIVPIIIGTLLSGACSNDEPTGGKGHQQTYSVVLKGITVAGEESSEELKDVSVF
QFSDGNLYKEEQLTPGQGGQSEISAVSGSRLYFLTGLEIPAGEKAKSEEEFRNTIIGEGLH
DNSAPDFMAAVVELESGVVTRSNAEVNVIMKRGVARIDLNTTADSKTQIKEVIVENAPAET
LPFLENVRASDKTVSYRKEFSSAFDGKQEGVFRLFESTRPVNIILRGTYGEVPIRLKVELP
VVERNKVYELAVLNVGAEVTGVFEIKPWEEGETIVGKPDTNQRLLLNASKSRIPEGVKVD
YENNILEVPATGADDMTLAFVTDTRIDISSTEGAGSGTSVGNMSVSEEAEGIVSSFNVSVA
AQGSGRLGYTVLVHLKNALLSGTYDYVEIRVAPSDKQIETVEIAGNVWMAFNARSRDLED
QIYPLDGATVEDMYHKSWINTVGGLFQFGRLYMYVPWQGYNPSNNLGNQTADAPWVN
DTHMPCPEGYRIPTGNEWQSLLPADQEIPGRYKAGNGETIAATLHIGEGTLITPSSGVTGT
QHYVKFTSEDTGRSLIIPLAGSKGDKSSSNNPAFGKRAVLWTNERNGLPGGYAWAYWLP
FEGAETTVIKKQRLQMEAFASVRCVKK

> BT3745 (SEQ ID NO: 477)
MKIKTLIACFILACAATSCIQDEALNSEAAIDACTGDDVQLANINADSKLINVYVNKGADLSK
QKLEFVIPEGATIKINDQVAGDTEATYDFSEETHSRKFTVTSEDGQWKPVYTVKVVLAELP
TSFNFEELLPSNDYDIFYEFQPGTSQEISKVLQWSSGNPGFKLTGMANSKTDYPTVQVAN
GFRGKGVKLETRDTGSFGAMVKMYIAAGNLFIGTFEVGNALTDPRKATNFGFQFYKRPK
TLKGHYKFKAGDVYSVEGKPQEGVRDKCDIYAVMYEAENNSVMLNGDDVFTSDKLVSLA
RIKPEDVVESDQWTDFEIPFEPVKGRVIDDTKLKNGKYKLGIVLSSSVDGAYFKGAVGSTL
YVDEVELICED

> BT3769 (SEQ ID NO: 478)
MKRIVFWMVALLLMSGVAMAQGNRQGGRQQMDPKTRAERMTERMVKEYSLNEDQKQ
QLQDVNLTWVQKMAANQGGRSKDNKAAKMTKEEREKKMAEMKKSREDYDAQLKKIMT
KEQYDSYVKKQAEREKQMKEGRQNRQKRQG

Fig. 19 (Cont. 5)

> BT3791 (SEQ ID NO: 479)
MKIVKYIVIVSLFSISACSDDDDKKNNERPGNLVELQVDVNEINIAQGDTRTVNITSGNGEY
VATSANEEVVVAEIDGNVVKLTAVEGHNNAQGVVYVSDKYFQRTKILVNTAAEFELKLNK
TLFTLYSQVEGSDEALIKIYTGNGGYSLEVIDDKNCIEVDQSTLEDTESFMVKGIAQGNAEI
KITDQKGKEAFVNLNVIAPKQITTDADEKGVLINSNQGSQQVKILTGNGEYKVLDAGDAKII
RLEVYGNVVTVGRKAGETSFTLTDAKGQVSQTIHVKIAPEKRWYMNLGKEYAVWTHFA
EMTGEGLEAVKVETNGFKLKKMTWELVARIDGTNWLQTFMGKEGYFILRGGDWENNKG
RQMELVGIDDKLKLRTGHGAFELGKWSHIALVVDCSKGKDDYNEKYKLYVNGKQVKWD
DSRKTDMDYSEIDLCAGNDGGRVSIGRASDNRCFLDGAILEARIWTVCRTEEQLKANAW
ELHEQNPEGLLGRWDFSAGAPTSYIEDGTNSDHELLMHISKYDSWNATEFPMSRFGEAP
IEVPFK

> BT4005 (SEQ ID NO: 480)
MKKFNWLLVMLLLALVPALQSCDDDGYSIGDIGWDWATVRATGGGGYYLEGDRWGMID
PVASSIPWYKPVDGERVVAFFNPLADTDKGAQVKIEGIQEVLTKEVEDMTAENEEEFGND
PIVIYQGDMWLGGKFLNIIFHQYLPRSEKHRISLVQNKIEPEAPETPEALNVDEDGYIHLEL
RYNTYDDVTGYRGWGRVSYNLEEFYPTAKDAAETEFKGFKVTINSKENGEGRVIVLDLD
HPVGVPEKAKDVHSTSFVK

> BT4167 (SEQ ID NO: 481)
MKKIRYIIASALVSIGLCACTDTWDSHYSKWETVIDNTEIQAVDEPAADFLKTAQDYSKMY
ELFDKTGVIKTWQEKNLMYTIMVVGNESTANANQPVTKAEGSEGQATAEEIFKAEAHITD
ALLSPSNLEDGQRLLMWNGKYVTVRIYDEPVDGMEPGIYFNGSKVKKVIKTNNAYIYDLE
DYINTPKALMEYLKDLPDEEYSIFKEMVLSRTQRVFDKAASTPIGIDKTGNTVYDSVFTEKS
QYFADKKLDLYSENITATLLVPSNDLIENALKEAKEKLKSWNMEREDSILNNWIFQTAFFSK
KYVKQDFIYNESDPASTQDFYSVFDQQWRTTVNKVDLDNPVELSNGVAYKITSLKIPTNKI
LIWRIKERFETFDQLTDEDKKYYYPGYNYISTYLKDIGENVQMNRVKQYVGANQPKPWLP
AVYCKSMMLWVVDTDRPGIFKFKCYRLVEDKASTTGFTAVPYKIPAGPYNFYMGFNGSR
SQVNATFYLNGKKIPKCESGPIPSSTMKGSNHDRSGGGYSELYKDSRYDRDGSTDLGVV
IFDKTEELEVTIEFTKGAKSDMEPTTWCFRPTVDLY

> BT4295 (SEQ ID NO: 482)
MSMKKNILIIGLASIFGIASGLISCSPDYETEFKVETLVVPDKSQAPITFPLLGGEHEIEVQTN
VPLDRWSAQSNAEWCKVVQHEGKVVVSASANNIYKQRRAEITVAYGHQSYSITVSQFGK
EPAILIGDKLQQEGYVEIIDAERETLTIPVATNLNLDNIIIPDTCNWIRLAEQPATFDAKTRAA
EDVNKQELKFTLDKSTETDVRYCTIILQSSQNYSYTASFLIKQQPRGYIVEIDEDKKIYEVKA
MGETITIPFKVNSPAGEVSYTYEVEESAQSWITPVSLPASRALRDVSESFIIKANTEVENQP
REGKITFKSTNSTDKVPSQFVVTVKQAGFIATPPLNVINATATPGAGSIQLQWEIPEDVDF
NKIKITYYDKVTKENKEILINDYKTTSYIIDDTYQCAGEYSFTINTYGPTGMETDSPVTITGIS
GEASEMERVTLTIDMLSDNANHVGDGGGLPALIDGKVNTYYHTKWNAPVTTEAHYVQIKL
NKPLKDLCFEYDARQSGVNNGGDVKAATIYGSMNGEFFESMGNEEFNLPTTNGGHATA
KNNVSGKQAYNYIRFTPTARRDKPLDYTVAGSAWWNMSEIYLYRIRHDEAWAREQLGI

Fig. 19 (Cont. 6)

> BT4297 (SEQ ID NO: 483)
MKKLFKIILGATVGSTLLLSSCNFLDVDPYFEATFKEDSIFHSKKNAEGYLWNTPKGFPDA
GAIWGNSWNPGESASDEITLKYQTNEFWGLQFSVGTINSRNLPIQNQWYDMYVIVARCN
KMLKEVYNVPDMNEMDRRRYIGYVHFMRGYAYYHLLMNWGPLIIVGDEELSTSEPAEYY
NRERATYDESVDYICDEFRLATQGIYSADEQSVNYYQRPTKGAAMALIARLRLFQASPLF
NGGAAARKCFGTWKRKSDGAYYVNQEYDPRRWAVAAAAAKQLTKMGYELHTVEADAQ
NPYPLASNVPTANFPDGAGNIDPYHSYSDMFTGEGIIQTNKEFIWAMESSNVTNYTHHSF
PVKFGGWGSMSVPQRVIDCYLMADGRTIHNSSAEYPYEPDFSRLTGESKKLGTYLLREN
VPMMYANRSARFYASIGFPGRYWPMSSASTDASYVNQQFWYSHDDTNAGIAGAGNNV
NDYSVSGYVPVKYIHPDDSWANGKGSVKGAFVTSPKPFPIIRYGEVLLEYVEALNRVEGT
VTVEVSDNTGTLIEETVSRDPAEMAKYFNMIRYRVGLPGVDANDMAEADNFEKIIRNERQ
VELFNEGYRYFDTRRWGTYLDEDANSSNWRGLDVTKDRTNANGNEGFWNIVTINTQNV
RDRIALPKMVFLPIRHDELLKVPNADQNFGWDR

Fig. 20
Colonies on LB agar plates
E. coli with P$_{BfP}$ GFP  
S17-1 + pWW3232
E. coli with no GFP  
S17-1 + pWW3056
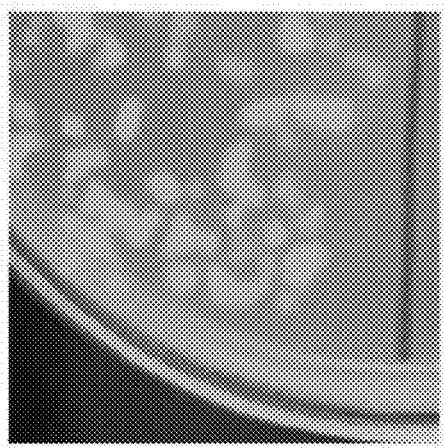
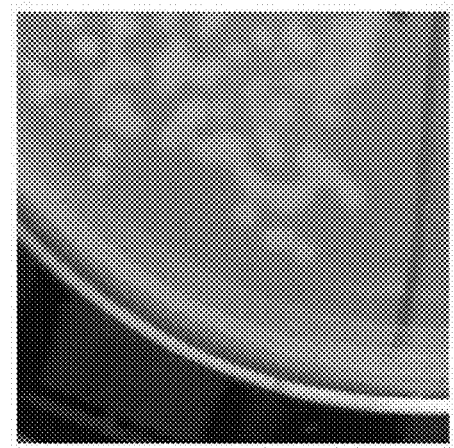
Spun down E. coli cells
E. coli with P$_{BfP}$ GFP
E. coli with no GFP
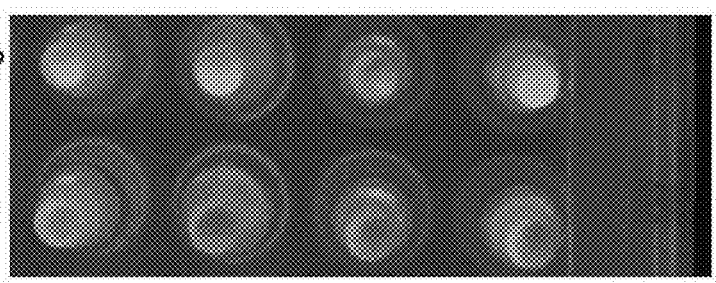

Fig. 21

P6 ( -69, +14) (a portion of SEQ ID NO: 388)

...caatg<u>gttaa</u>tctatt<u>gttaa</u>aatttaaagtttcac<u>ttg</u>aactttcaaataatgttct<u>tatatttg</u>cagtgtc<u>gaaagaaa</u>ca...

(SEQ ID NO: 490)

P5 ( -66, +10) (a portion of SEQ ID NO: 407)

...caat<u>gttaa</u>aaca<u>gttaa</u>tgcacgttaaagtat<u>ttg</u>ctactgagaaatatatccg<u>tatatttg</u>cagcgta<u>gaa</u>gtt...

(SEQ ID NO: 491)

COMPOSITIONS AND METHODS FOR NUCLEIC ACID EXPRESSION AND PROTEIN SECRETION IN BACTEROIDES

CROSS-REFERENCE

This application is a National Stage Entry of International Application No. PCT/US2017/028066, filed Apr. 18, 2017, which application claims the benefit of U.S. Provisional Application No. 62/325,379, filed Apr. 20, 2016, each of which application is incorporated herein by reference.

GOVERNMENT RIGHTS

This invention was made with Government support under contracts OD006515 and DK085025 awarded by the National Institutes of Health. The Government has certain rights in the invention.

INCORPORATION BY REFERENCE OF SEQUENCE LISTING PROVIDED AS A TEXT FILE

A Sequence Listing is provided herewith as a text file "STAN-1296_Seqlist_ST25_replacement.txt" created on Mar. 12, 2020 and having a size of 601 KB. The contents of the text file are incorporated by reference herein in their entirety.

INTRODUCTION

The human gastrointestinal tract is a highly evolved human-microbial interface in which resident microbes are continually sensing and responding to numerous biochemical cues. In addition to their native role in digestion, immune function, metabolism, and the nervous system, gut-resident bacteria have untapped potential to be engineered to conduct specific tasks, record events, and make decisions. Such technology would benefit greatly from the development of genetic tools for manipulating members of the microbiota. Creation and implementation of such a toolkit would vastly expand the array of questions about the gut microbiota that can be experimentally addressed, and provide a foundation for engineering diagnostic or therapeutic microbes. There is a need in the art for genetic tools for abundant gut bacterial species.

While great advances have been made with genetic manipulation of proteobacteria, particularly *E. coli*, this taxon is typically not a prominent component of the healthy human adult microbiota. The *Bacteroides*, the most abundant genus within the US American gut, are capable of utilizing both dietary and host-derived nutrient sources, and are known to have an important role in immune development. Although some tools are available for genetic manipulation and expression in *Bacteroides*, the strongest promoters identified to date are insufficient, e.g., for microscopic imaging of fluorescent protein expression.

There is a need in the art for compositions and methods for reliable nucleic acid expression (generation of RNA and protein from DNA) in prokaryotes (e.g., *Bacteroides*). The present disclosure provides such methods and compositions (e.g., nucleic acids, expression vectors).

SUMMARY

Compositions and methods are provided for the expression of nucleic acids. For example, provided are nucleic acids that include a promoter operably linked to a heterologous nucleotide sequence of interest (e.g., an insertion sequence such as a multiple cloning site, a heterologous nucleic acid sequence, such as a transgene, e.g., a selectable marker, a reporter, a therapeutic polypeptide, and the like), where the promoter is operable in a *Bacteroides* cell. Also provided are nucleic acids that includes a promoter (operable in a prokaryotic cell such as a *Bacteroides* cell) operably linked to: (i) a sequence encoding a synthetic ribosomal binding site (RBS) and (ii) nucleotide sequence of interest. Also provided are fusion proteins (and nucleic acids encoding them) in which a secreted *Bacteroides* polypeptide is fused to a heterologous polypeptide of interest. Also provided are prokaryotic cells (e.g., *E. coli*, a *Bacteroides* cell, and the like) that include nucleic acids such as those described above.

Provided are methods of expressing a transgene in a prokaryotic cell (e.g., using a subject nucleic acid), methods of detectably labeling a *Bacteroides* cell in an animal's gut (e.g., labeling *Bacteroides* cells that are distinguishable from one another), and methods of delivering a protein to an individual's gut, where such methods can be employed as methods of treatment.

BRIEF DESCRIPTION OF THE DRAWINGS

The invention is best understood from the following detailed description when read in conjunction with the accompanying drawings. The patent or application file contains at least one drawing executed in color. Copies of this patent or patent application publication with color drawing(s) will be provided by the Office upon request and payment of the necessary fee. It is emphasized that, according to common practice, the various features of the drawings are not to-scale. On the contrary, the dimensions of the various features are arbitrarily expanded or reduced for clarity. Included in the drawings are the following figures.

(FIG. 2a) Native Bt promoters expected to give high protein expression from literature ($P_{rRNA}$ and $P_{BT1311}$) and transcriptomics data ($P_{BT1830}$ and $P_{BT4615}$) were compared to a phage promoter ($P_{BfP1E6}$) (SEQ ID NO: 8) via fluorescence from GFP expression. The RBS used was either the strongest RBS experimentally identified from a 192 member RBS library for each promoter (black bars) or the strongest RBS from the $P_{BfP1E6}$ RBS library (grey bars). (FIG. 2b) Fitness of the high expression Bt strain, with $P_{BfP1E6}$ driven GFP, was tested in competition against a non-expressing strain showing only a minor fitness defect and stable colonization over a 10-week period in gnotobiotic mice. (FIG. 2c) The bi-colonized mouse from FIG. 2b with the median ratio of expressing and non-expressing strains was selected. Imaging of the distal colon demonstrates that the endogenous fluorescence from the GFP expressing portion of the population was sufficient for detection in vivo. Host tissue (lower left) was bordered by phalloidin stain of actin (red), and luminal contents contained both expressing (green) and non-expressing (white; DAPI only) Bt. (FIG. 2d) The fluorescence of 214 Bt strains, each containing a mutation in the $P_{BfP1E6}$ promoter was compared to the $P_{BfP1E6}$ level. The x-axis represents the position of each mutation and diamonds, circles, triangles and squares represent a mutation to the residue A, C, G or T, respectively, with the average mutant value at each position traced in grey. The previously characterized −7 and −33 motifs are highlighted in blue and the putative UP-element motifs revealed here are highlighted in red. (FIG. 2e) Constitutive promoters derived from $P_{BfP1E6}$ were compared via luciferase expression dependent luminescence relative to $P_{BfP1E6}$. (FIG. 2f) Different RBSs under $P_{BfP1E6}$-driven luciferase were compared. RBS1 (sr1) was rationally designed for weak expression and RBS2-8 (sr2-8) were selected from the A/T rich RBS library. Error bars represent the 95% confidence interval for replicates of at least 3 independent experiments (FIG. 2a, FIG. 2d, FIG. 2e, FIG. 2f) or 5 different mice (FIG. 2b).

(FIG. 3a) Luminescence was measured from 56 promoter-RBS combinations (all possible FIG. 2e-f combinations, excluding the weakest promoter) driving luciferase expression in each of four species: Bt, Bv, Bo and Bu. Measured luminescence is plotted against expected luminescence calculated by multiplying relative promoter and RBS strengths in Bt (FIG. 2e-f). Individual strains measurements, a linear fit of $\log_{10}$ values, and associated $R^2$ are colored by species: Bt (blue), Bv (red), Bo (green) and Bu (purple). (FIG. 3b) A unique combination of one of three GFP expression levels or two mCherry expression levels were encoded in each of six Bacteroides species. Independently measured single-cell fluorescence profiles representing 95% of the cells for each species, as determined by microscopy of mid-log cultures, are plotted with the associated species label. (FIG. 3c) The single-cell fluorescence profile from imaging the six member community in the distal colon is shown. (FIG. 3d) A representative transformed image of the six-member community within the distal colon is shown. Each pixel was independently transformed to better display log-separated GFP intensity and showed clearly distinguished cells for all six species (blue Be; cyan Bo; green Bt; red Bf, orange Bu; yellow Bv). Pixels near transformation thresholds are colored in grey, few ambiguous cells are present. (FIG. 3O) A larger transformed image, used for FIG. 3d, shows the six Bacteroides species localization relative to host nuclei (blue near bottom of image), actin-delineated epithelial boundary (white) and mucus (purple). The smaller image in FIG. 3d is outlined with a dashed white box. (FIG. 3f) An image from the six member community shows more clonal Bacteroides population distributions within ingested plant material (plant cell walls in purple) in the distal colon. Bo (cyan) predominates in this image, while populations of Bt, Bu and Bv can also be seen.

(FIG. 5a) Bt strains with GFP expression driven by $P_{rRNA}$ with RBS sequences from one of three different RBS libraries: an A/G-rich degenerate sequence, $N_{11}R_7N_2$cgtaaATG (SEQ ID NO: 373), an unbiased degenerate sequence, $N_{20}$cgtaaATG (SEQ ID NO: 374), and an A/T-rich sequence $N_9W_3A_3W_2tWaNaataATG$ (SEQ ID NO: 375). For each library 192 colonies were screened for GFP fluorescence. Most readings were close to background autofluorescence, 1 au. The fluorescence readings from the strains of the A/T-rich RBS library was significantly higher than from the strains of the A/G-rich or unbiased degenerate RBS libraries, ($P=2\times10^{-14}$ and $4\times10^{-9}$, respectively, Student's t-test). When repeated in triplicate, the highest expression strain from the A/T-rich library produced fluorescence at 1.4 au. (FIG. 5b) RBS libraries were generated similarly for $P_{BT1763}$-driven GFP expression and at least 72 colonies for each library were screened. Similar to PrRNA, the A/T-rich libraries produce a populations with higher fluorescent expression than the other two libraries ($P<2\times10^{-8}$). Additionally, the fluorescence readings from the strains of the A/G rich RBS library were significantly weaker than those of the unbiased degenerate RBS library ($P=4\times10^{-5}$).

FIG. 8. In vitro fitness assay of GFP-expressing Bt. Bt with $P_{BfP1E6}$-driven GFP expression was mixed 1:1 with a non-expressing Bt strain, grown anaerobically in TYG medium and passaged twice per day at 1:50 and 1:100 dilution, giving a product of the dilutions of $1.6\times10^{10}$ (~33 doublings) at day 4. Each day duplicate cultures at mid-log phase were assayed for bulk fluorescence (relative to 100% GFP positive and negative cultures). Error bars represent the 95% confidence interval from 2 independent biological replicates.

(FIG. 9a) A 203×203 μm confocal image was taken of a distal colon section with endogenous GFP fluorescence and staining with DAPI for host nuclei and bacteria (white) and phalloidin for the host epithelial boundary (red). Dietary material also fluoresces strongly in the DAPI channel and can be distinguished from bacteria by its large size. (FIG. 9b) In an expanded portion of FIG. 9a represented by the magenta dashed box, bacteria with only DAPI (white) or DAPI and GFP fluorescence can be seen. (FIG. 9c) In ImageJ (NIH), the deconvolved DAPI image is thresholded to generate a mask of individual objects of bacterial cell size. (FIG. 9d) The GFP channel is used to quantify the average fluorescent intensity for each object delineated in FIG. 9c. (FIG. 9e) A histogram of the fluorescence value of single cells demonstrates a large separation between non-fluorescing (black bars), most of which are below 1 au, and fluorescing (green bars) cells, most of which are above 20 au. Objects of ambiguous intensities (grey bars) make up about 4% of objects.

(FIG. 11a) (SEQ ID NO: 512) The upstream region important for phage promoter function is conserved in native Bt promoters. For each gene in the Bt genome, a candidate promoter sequence was identified by the presence of the −7 conserved sequence, TAnnTTTGnnn (SEQ ID NO: 372), ending within 10 to 60 nucleotides of the start codon of the first gene in the operon (operons predicted by microbesonline.org). These criteria were met for 898 genes, which were entered into the WebLogo 3 (http)// (weblogo)dot (threeplusone) dot (com) sequence logo creation software to illustrate the information content of each residue. The −33 box reported to conserve the TTTG sequence is highlighted in blue and the upstream regions found to be important in the phage promoter mutational analysis are highlighted in red, with the sequence of the phage promoters aligned below the logo for reference. Despite the many misidentified putative promoters expected in this simple analysis, the −33 region did appear to be conserved in this dataset, and the −50 region appeared to be more highly conserved. (FIG. 11b) A standard curve of luminescence produced from purified NanoLuc (Promega) luciferase protein is shown for estimating the absolute protein concentrations. The linear fit to the log 10 values and the corresponding equation and $R^2$ is shown. (FIG. 11c) Luminescence produced by NanoLuc driven by the different phage promoters in FIG. 4B was measured concurrently with the standard curve and compared. Using measured CFUs ($5 \times 10^6$ CFU/µL) and other estimates (see methods) that corresponded to a ~0.5% cytoplasmic fraction of saturated culture volume, the absolute cytoplasmic concentration of NanoLuc is estimated for each strain. (FIG. 11d) Relative expression from promoters P_BfP1E4, P_BfP5E4, P_BfP2E5, P_BfP4E5 and, P_BfP1E6 driving GFP (bottom line) or mCherry (top line) is compared to corresponding luciferase expression (dotted/center line).

(FIG. 13a) A three-channel image of the field of view used for FIG. 3e, shows DAPI (blue), sfGFP (green), UEAI-Alexa488 for mucus (also in green), mCherry (red), and Phalloidin-Alexa594 for actin delineation of host epithelium (also in red). (FIG. 13b) Using linear unmixing on a Zeiss LSM 700 confocal microscope, the image was separated into 5 channels, DAPI (blue), sfGFP (green), UEAI-Alexa488 (cyan), mCherry (red), and Phalloidin-Alexa594 (purple), while the background autofluorescent material was largely eliminated. This 5-channel image was then transformed, to better visualize the log-separated GFP values, to give FIG. 3e.

(FIG. 14a) A community of Bf, Bo and Bv was used to estimate error in identifying member of the six-member community from FIG. 3. The single-cell fluorescence profiles from independent culture for this community were plotted with the associated species label (similar to FIG. 3b). (FIG. 14b) A germ-free mouse was colonized with the three member community. An unprocessed image with high GFP gain, so that intermediate GFP levels can be visualized, from the distal colon is shown. (FIG. 14c) The single cell fluorescent values of individual cells from the previous image, (FIG. 14b), clustered as expected, but with larger deviations than seen in independent culture (FIG. 14a), due in part to difficulties in microscopy and image processing techniques associated with imaging gut sections. Thresholds used to determine species identity were used to quantify the number of cells that would be miscategorized (area in red) as the absent species (Bt, Bu and Be) giving a 5.9% error rate.

FIG. 15 depicts Table 1, which shows the percentage of correctly assembled, genomically integrated constructs for each species using the high-throughput cloning and conjugation protocol; and Table 2, which shows a list of oligonucleotides used for RBS libraries. Top to bottom in Table 2: (SEQ ID NOs: 365-370).

FIG. 16 depicts Table 3, which shows a list of plasmids that were used in the Examples section. The sequences for each listed construct are set forth as, from top to bottom, SEQ ID NOs: 94-148.

FIG. 17a-17d. Data related to diverse *Bacteroides* species engineered to secrete peptides into extracellular space. (FIG. 17a) *B. thetaiotaomicron* cell culture pellet and filter sterilized supernatant were analyzed via mass spectrometry proteomics and candidate secreted proteins were identified by abundance in the cell culture supernatant. (FIG. 17b) Protein product of BT0525 can direct a 6× His/3×FLAG peptide outside the cell in six divergent *Bacteroides* species. Western blot analysis of cell pellet (P) and culture supernatant (S) from mid-log cultures of *Bacteroides* species using a monoclonal anti-3× FLAG antibody. (FIG. 17c) Schematic of cargo peptides secreted via BT0525 using a designed cleavable linker system to allow for release into extracellular space. (FIG. 17d) Secreted cargo 6× His/3×FLAG peptide is released from carrier BT0525 upon addition of mouse cecal extract (CE) when fusion linker is designed to be targeted by gut proteases. Western blot of culture supernatant from *B. thetaiotaomicron* secreting fusion proteins with either a non-cleavable or cleavable linker, exposed to either PBS or CE, using anti-3×FLAG monoclonal antibody.

(FIG. 18a) Gnotobiotic mice colonized with a model three-member community of *Edwardsiella tarda, Clostridium scindens*, and *Bacteroides* vulgatus were given 5% DSS in drinking water. Mice that also received *B. theta* secreting anti-inflammatory peptides lost significantly less weight than mice that were untreated. (FIG. 18b) Disease Activity Index at time of sacrifice was significantly lower in mice that received *B. thetaiotaomicron* secreting an effective anti-inflammatory protein than those receiving a tripeptide only.

FIG. 19 depicts amino acid sequences of proteins found (during work disclosed in the examples section herein) to be secreted from *B. thetaiotaomicron* cultures. The listed proteins are a non-limiting list of possible proteins that can be used as a secreted *Bacteroides* protein that is part of a subject secreted fusion protein (e.g., where a polypeptide of interest is fused to a secreted *Bacteroides* protein).

FIG. 20 depicts *E. coli* cells expressing a GFP transgene that is operably linked to the promoter of SEQ ID NO: 388 (which is demonstrated here to be operable in *Bacteroides* cells, and also in *E. coli* cells). S17-1 is a strain of *E. coli* used to conjugate plasmids over to *Bacteroides* cells.

FIG. 21 depicts a sequence alignment of the promoters of Table 6.

(FIG. 24a) Fecal densities of sequentially introduced isogenic Bt strains with differing antibiotic resistance in conventional mice by selective plating (erm, top line; tet, bottom line). (FIG. 24b) Schematic for experiment in (FIG. 24C-FIG. 24F) in which germ-free mice are colonized with GFP- and RFP-expressing Bt strains either one week apart (bottom) or simultaneously (top). (FIG. 24c) The relative abundance of GFP expressing Bt, relative to the total (GFP plus RFP) Bt is quantified for lumen (grey bars) and crypt (black bars) for the co-colonized and sequentially colonized mice. Error bars represent the 95% confidence interval for mice (n=3) in each group ($*P<0.05$, $**P<0.01$). (FIG. 24d) Image of luminal and crypt bacteria from co-colonized mouse proximal colon. The lumen-epithelium interface is represented by the dashed white line. Scale bar, 10 315 μm. (FIG. 24e) Representative crypt from simultaneous colonization. (FIG. 24f) Representative crypt from sequential colonization.

DETAILED DESCRIPTION

Figure 1:
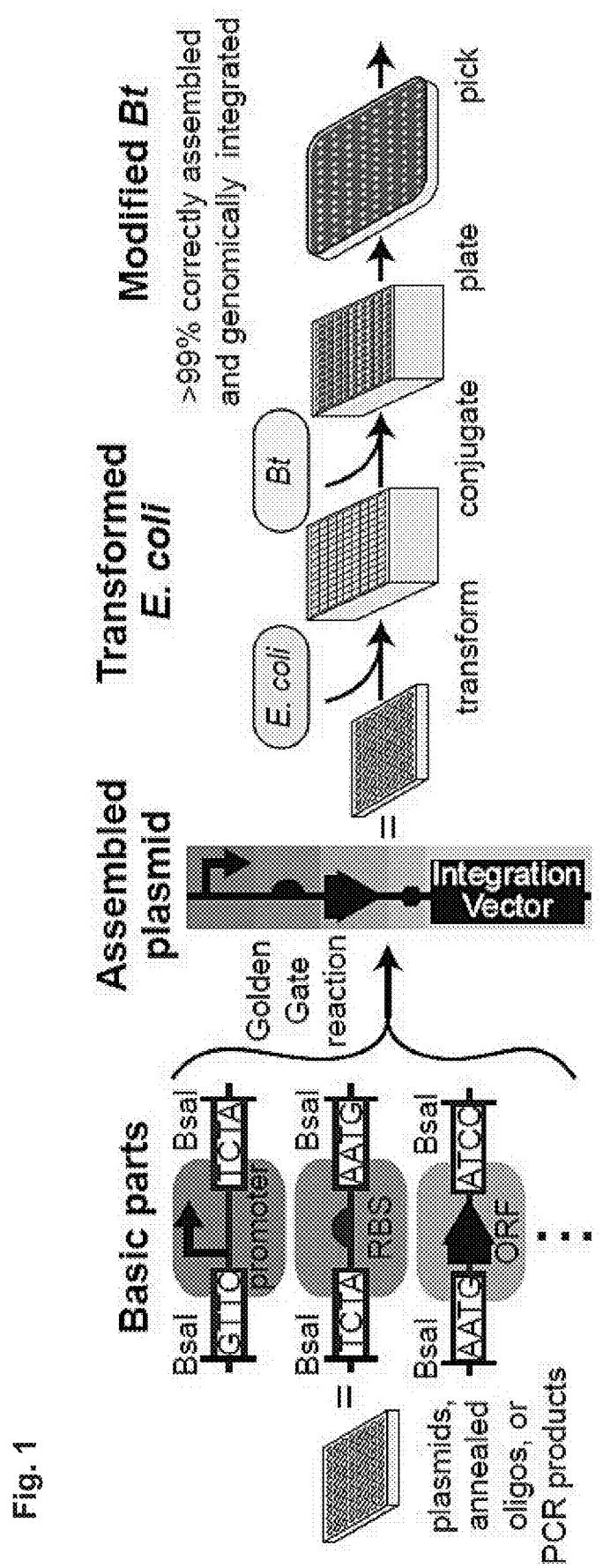
FIG. 1: Schematic of the high-throughput cloning and genomic integration pipeline for *Bacteroides* using 96-well compatible liquid handling steps. The pipeline was applied to 54 specifically designed genomically integrated cassettes across four *Bacteroides* species, resulting in more than 99% correct plasmid assembly.

Before the present methods and compositions are described, it is to be understood that this invention is not limited to particular method or composition described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limits of that range is also specifically disclosed. Each smaller range between any stated value or intervening value in a stated range and any other stated or intervening value in that stated range is encompassed within the invention. The upper and lower limits of these smaller ranges may independently be included or excluded in the range, and each range where either, neither or both limits are included in the smaller ranges is also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, some potential and preferred methods and materials are now described. All publications mentioned herein are incorporated herein by reference to disclose and describe the methods and/or materials in connection with which the publications are cited. It is understood that the present disclosure supercedes any disclosure of an incorporated publication to the extent there is a contradiction.

As will be apparent to those of skill in the art upon reading this disclosure, each of the individual embodiments described and illustrated herein has discrete components and features which may be readily separated from or combined with the features of any of the other several embodiments without departing from the scope or spirit of the present invention. Any recited method can be carried out in the order of events recited or in any other order which is logically possible.

It must be noted that as used herein and in the appended claims, the singular forms "a", "an", and "the" include plural referents unless the context clearly dictates otherwise. Thus, for example, reference to "a cell" includes a plurality of such cells (e.g., a population of such cells) and reference to "the protein" includes reference to one or more proteins and equivalents thereof, e.g. polypeptides, known to those skilled in the art, and so forth.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

Definitions

By a "DNA molecule" it is meant the polymeric form of deoxyribonucleotides (adenine, guanine, thymine, or cytosine) in either single stranded form or a double-stranded helix. This term refers only to the primary and secondary structure of the molecule, and does not limit it to any particular tertiary forms. Thus, this term includes double-stranded DNA found, inter alia, in linear DNA molecules (e.g., restriction fragments), viruses, plasmids, and chromosomes.

By a DNA "coding sequence" it is meant a DNA sequence which is transcribed and translated into a polypeptide when placed under the control of appropriate regulatory sequences. The boundaries of the coding sequence are determined by a start codon at the 5' (amino) terminus and a translation stop codon at the 3' (carboxyl) terminus. A transcription termination sequence may be located 3' to the coding sequence.

"DNA regulatory sequences", as used herein, are transcriptional and translational control sequences, such as promoters, terminators, Ribosome binding sites (RBSs), and the like, that provide for and/or regulate expression of a coding sequence in a host cell.

In some embodiments, a subject nucleotide sequence (e.g., a promoter sequence) is modified relative to a corresponding wild type sequence. A "corresponding wild type sequence" is the wild type (naturally occurring) sequence that has the highest identity with the sequence in question. Such a sequence will usually have a similar function as the sequence in question, but this is not necessarily the case. For example, a synthetic promoter sequence has at least one mutation relative to a corresponding wild type promoter sequence, and the corresponding wild type promoter sequence is the wild type promoter sequence most similar to the synthetic sequence. Likewise, a synthetic RBS sequence has at least one mutation relative to a corresponding wild type RBS sequence, and the corresponding wild type RBS sequence is the wild type RBS sequence most similar to the synthetic sequence. A "corresponding wild type sequence" (e.g., nucleotide sequence, amino acid sequence) can be identified at the nucleotide sequence level (and when the sequence codes for a protein, the encoded amino acid sequence can also be evaluated) using any convenient method (e.g., using any convenient sequence comparison/alignment software such as BLAST, etc.). Such methods will be known and readily available to one of ordinary skill in the art.

The terms "peptide," "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones.

The terms "host", "host cell" and "recombinant host cell" are used interchangeably herein to indicate a prokaryotic cell into which one or more nucleic acids such as isolated and purified nucleic acids (e.g., vectors) have been introduced. It is understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein.

The term "isolated" and "purified nucleic acid" refers to the state in which a nucleic acid can be. In such a case, the nucleic acids will be free or substantially free of material with which they are naturally associated such as other nucleic acids with which they are found in their natural environment, or the environment in which they are prepared (e.g. cell culture).

The terms "transformation", "transformed" or "introducing a nucleic acid into a host cell" denote any process wherein an extracellular nucleic acid like a vector, with or without accompanying material, enters a host cell (e.g., a prokaryotic cell, a *Bacteroides* cell, an *E. coli* cell, etc.). The term "cell transformed" or "transformed cell" means the cell or its progeny into which the extracellular nucleic acid has been introduced and thus includes the extracellular nucleic acid. The introduced nucleic acid may or may not be integrated (covalently linked) into the genome of the cell. For example, in some cases, the introduced nucleic acid integrates into the genome of the cell (as a chromosomal integrant). In some cases, the introduced nucleic acid is maintained on an episomal element (extra chromosomal element) such as a plasmid.

Any convenient method can be used to introduce a nucleic acid into a prokaryotic cell, e.g., by electroporation (e.g., using electro-competent cells), by conjugation, by chemical methods (e.g., using chemically competent cells), and the like.

The amino acids described herein are preferred to be in the "L" isomeric form. The amino acid sequences are given in one-letter code (A: alanine; C: cysteine; D: aspartic acid; E: glutamic acid; F: phenylalanine; G: glycine; H: histidine; I: isoleucine; K: lysine; L: leucine; M: methionine; N: asparagine; P: proline; Q: glutamine; R: arginine; S: serine; T: threonine; V: valine; W: tryptophan: Y: tyrosine; X: any residue). In keeping with standard polypeptide nomenclature, NH2 refers to the free amino group present at the amino terminus (the N terminus) of a polypeptide, while COOH refers to the free carboxy group present at the carboxy terminus (the C terminus) of a polypeptide.

General methods in molecular and cellular biochemistry can be found in such standard textbooks as Molecular Cloning: A Laboratory Manual, 3rd Ed. (Sambrook et al., HaRBor Laboratory Press 2001); Short Protocols in Molecular Biology, 4th Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); and Viral Vectors (Kaplift & Loewy eds., Academic Press 1995); the disclosures of which are incorporated herein by reference. Reagents, cloning vectors, and kits for genetic manipulation referred to in this disclosure are in many cases available from commercial vendors such as BioRad, Stratagene, Invitrogen, Sigma-Aldrich, and ClonTech.

Compositions

Provided are nucleic acids (e.g., expression vectors) that include a promoter operably linked to a nucleotide sequence of interest. In some cases, a subject promoter is operable (functional) in a prokaryotic cell (e.g., a *Bacteroides* cell). Also provided are prokaryotic cells such as *Bacteroides* cells.

*Bacteroides* Cells

The term "*Bacteroides* cell" is used herein to refer to a cell of the genus *Bacteroides* (e.g., when referencing cells in which a subject promoter is operable, in the context of a cell that includes a subject nucleic acid, in the context of a subject method, and the like). Likewise, the term "*Bacteroides* phage" refers to a phage that 'infects' a *Bacteroides* cell (i.e., a phage that infects a cell of the genus *Bacteroides*).

As such, in some cases, a subject cell is a *Bacteroides* cell. In some cases, a subject promoter is operable in a *Bacteroides* cell. In some cases, a subject promoter is (or is derived from) a *Bacteroides* phage promoter. In some cases, a subject cell (e.g., a cell of a subject method, a cell that includes a subject nucleic acid, a cell in which a subject promoter is operable, and the like) is a *Bacteroides* cell. Examples of species within the genus *Bacteroides* include but are not limited to: *B. fragilis* (Bt). *B. distasonis* (Bd), *B. thetaiotaomicron* (Bt), *B. vulgatus* (Bv), *B. ovatus* (Bo), *B. eggerrthii* (Be), *B. merdae* (Bm), *B. stercoris* (Bs), *B. uniformis* (Bu), and *B. caccae* (Bc).

In some cases, a subject *Bacteroides* cell (e.g., a cell of a subject method, a cell that includes a subject nucleic acid, a cell in which a subject promoter is operable, and the like) is a species selected from: *B. fragilis* (B), *B. thetaiotaomicron* (Bt), *B. vulgatus* (Bv), *B. ovatus* (Bo), and *B. uniformis* (Bu). In some cases, the *Bacteroides* cell is a species selected from: *B. fragilis* (B), *B. distasonis* (Bd), *B. thetaiotaomicron* (Bt), *B. vulgatus* (Bv), *B. ovatus* (Bo), *B. eggerrthii* (Be), *B. merdae* (Bm), *B. stercoris* (Bs), *B. uniformis* (Bu), and *B. caccae* (Bc). In some cases, the *Bacteroides* cell is a species selected from: *B. fragilis* (BO, *B. thetaiotaomicron* (Bt), *B. vulgatus* (Bv), *B. ovatus* (Bo), and *B. uniformis* (Bu). In some cases, the *Bacteroides* cell is a species selected from: *B. thetaiotaomicron* (Bt), *B. vulgatus* (Bv), *B. ovatus* (Bo), and *B. uniformis* (Bu).

Promoter

As noted above, provided are nucleic acids (e.g., expression vectors) that include a promoter operably linked to a nucleotide sequence of interest. As used herein, a "promoter" or "promoter sequence" is a DNA regulatory region capable of recruiting RNA polymerase in a cell and initiating transcription of a downstream (3' direction) sequence. Thus, a promoter is nucleic acid sequence sufficient to direct transcription of a nucleic acid sequence to which it is operably linked.

The promoter of a subject nucleic acid is operable in a *Bacteroides* cell. When a promoter is operable in a *Bacteroides* cell, the promoter is functional in a cell of the genus *Bacteroides*. Because some promoters can be operable in more than one type of cell, a phrase such as "operable in a *Bacteroides* cell" or "operable in *Bacteroides* cells" is not limiting in the sense that it does not mean that such a promoter is not operable in other cell types (i.e., it does not mean that the promoter is not functional in other prokaryotic cells). For example, a promoter that is operable in *Bacteroides* cells may also be operable in other types of prokaryotic cells (e.g., *E. coli* cells) (e.g., see FIG. 20). Thus, in some cases, a subject promoter, in addition to being operable in *Bacteroides* cells, is also operable in non-*Bacteroides* cells (e.g., prokaryotic cells such as *E. coli* cells).

In some cases, a subject promoter is operable in a *Bacteroides* cell (e.g., *B. fragilis* (B), *B. distasonis* (Bd), *B. thetaiotaomicron* (Bt), *B. vulgatus* (Bv), *B. ovatus* (Bo), *B. eggerrthii* (Be), *B. merdae* (Bm), *B. stercoris* (Bs), *B. uniformis* (Bu), *B. caccae* (Bc), and the like). In some cases, a subject promoter is operable in a *Bacteroides* cell selected from: *B. fragilis* (Bt), *B. distasonis* (Bd), *B. thetaiotaomicron* (Bt), *B. vulgatus* (Bv), *B. ovatus* (Bo), *B. eggerrthii* (Be), *B. merdae* (Bm), *B. stercoris* (Bs), *B. uniformis* (Bu), and *B. caccae* (Bc). In some cases, a subject promoter is operable in a *Bacteroides* cell selected from: *B. fragilis* (Bt), *B. thetaiotaomicron* (Bt), *B. vulgatus* (Bv), *B. ovatus* (Bo), and *B. uniformis* (Bu). In some cases, a subject promoter is operable in a *Bacteroides* cell selected from: *B. thetaiotaomicron* (Bt), *B. vulgatus* (Bv), *B. ovatus* (Bo), and *B. uniformis* (Bu). In some cases, a subject promoter is operable in prokaryotic cells (e.g., *Bacteroides* cells, *E. coli*, etc.). In some cases, a subject promoter is operable in *E. coli*.

In some embodiments, a promoter of a subject nucleic acid includes a nucleotide sequence of a wild type (i.e., naturally occurring) promoter from a phage (e.g., a *Bacteroides* phage, i.e., a phage that infects *Bacteroides* cells). For example, in some cases, a promoter of a subject nucleic acid includes the *Bacteroides* phage promoter sequence set forth in any of SEQ ID NOs: 8, 388-397, and 405-407. In some cases, a promoter of a subject nucleic acid includes the *Bacteroides* phage promoter sequence set forth in any of SEQ ID NOs: 388 and 407. In some cases, a promoter of a subject nucleic acid includes the *Bacteroides* phage promoter sequence set forth in SEQ ID NO: 8. In some cases, a promoter of a subject nucleic acid includes the *Bacteroides* phage promoter sequence set forth in SEQ ID NO: 388. In some cases, a promoter of a subject nucleic acid includes the *Bacteroides* phage promoter sequence set forth in SEQ ID NO: 406. In some cases, a promoter of a subject nucleic acid includes the *Bacteroides* phage promoter sequence set forth in SEQ ID NO: 407. In some cases, a promoter of a subject nucleic acid is a synthetic promoter (i.e., not naturally occurring, e.g., a sequence that has at least one mutation relative to a corresponding wild type promoter sequence).

As described below in the examples section, the inventors have isolated at least two wild type phage promoter sequences, performed mutagenesis and truncation experiments, and performed sequence alignments to identify positions within the promoter sequences that account for controlling expression of an operably linked nucleotide sequence of interest. For example, in some embodiments, a promoter of a subject nucleic acid includes the nucleotide sequence: GTTAA $(n)_{x1}$ GTTAA $(n)_{x2}$ TA $(n)_2$ TTTG (SEQ ID NO: 400), where:
(1) x1 can be an integer in a range of from 3-7 (e.g., in some cases x1 is an integer in a range of from 4-6, in some cases x1 is 4, and in some cases, x1 is 6); and
(2) x2 can be an integer in a range of from 36-38 (e.g., in some cases x2 is 37). In some cases, x1 is an integer in a range of from 3-7 and x2 is an integer in a range of from 36-38.

In some cases, x1 is an integer in a range of from 4-6 and x2 is in integer in a range of from 36-38. In some cases, x1 is an integer in a range of from 3-7 and x2 is 37. In some cases, x1 is an integer in a range of from 4-6 and x2 is 37.

In some embodiments, a promoter of a subject nucleic acid includes a nucleotide sequence having 80% or more identity (e.g., 85% or more, 90% or more, 95% or more, or 100% identity) with the nucleotide sequence: GTTAA $(n)_{x1}$ GTTAA $(n)_{x2}$ TA $(n)_2$ TTTG (SEQ ID NO: 400) (where the percent identity is calculated using only the defined nucleotides of the sequence set forth in SEQ ID NO: 400), where:
(1) x1 can be an integer in a range of from 3-7 (e.g., in some cases x1 is an integer in a range of from 4-6, in some cases x1 is 4, and in some cases, x1 is 6); and
(2) x2 can be an integer in a range of from 36-38 (e.g., in some cases x2 is 37). In some cases, x1 is an integer in a range of from 3-7 and x2 is an integer in a range of from 36-38.

In some cases, x1 is an integer in a range of from 4-6 and x2 is in integer in a range of from 36-38. In some cases, x1 is an integer in a range of from 3-7 and x2 is 37. In some cases, x1 is an integer in a range of from 4-6 and x2 is 37.

In some embodiments, a promoter of a subject nucleic acid includes the nucleotide sequence: GTTAA $(n)_{x1}$ GTTAA $(n)_{x2}$ TA $(n)_2$ TTTG $(n)_{x3}$ GAA (SEQ ID NO: 401), where:
(1) x1 can be an integer in a range of from 3-7 (e.g., in some cases x1 is an integer in a range of from 4-6, in some cases x1 is 4, and in some cases, x1 is 6);
(2) x2 can be an integer in a range of from 36-38 (e.g., in some cases x2 is 37); and
(3) x3 can be an integer in a range of from 4-12 (e.g., in some cases x3 is an integer in a range of from 7-11, in some cases x3 is an integer in a range of from 4-7, in some cases x3 is an integer in a range of from 6-8, in some cases x3 is 7, in some cases x3 is 11).

In some cases, x1 is an integer in a range of from 3-7, x2 is an integer in a range of from 36-38, and x3 is an integer in a range of from 4-12. In some cases, x1 is an integer in a range of from 3-7, x2 is an integer in a range of from 36-38, and x3 is an integer in a range of from 4-7. In some cases, x1 is an integer in a range of from 3-7, x2 is an integer in a range of from 36-38, and x3 is an integer in a range of from 7-11. In some cases, x1 is an integer in a range of from 4-6, x2 is in integer in a range of from 36-38, and x3 is an integer in a range of from 6-8. In some cases, x1 is an integer in a range of from 4-6, x2 is in integer in a range of from 36-38, and x3 is 7. In some cases, x1 is an integer in a range of from 3-7, x2 is 37, and x3 is 7. In some cases, x1 is an integer in a range of from 4-6, x2 is 37, and x3 is 7. In some cases, x1 is an integer in a range of from 3-7, x2 is 37, and x3 is an integer in a range of from 7-11. In some cases, x1 is an integer in a range of from 4-6, x2 is 37, and x3 is an integer in a range of from 7-11.

In some embodiments, a promoter of a subject nucleic acid includes a nucleotide sequence having 80% or more identity (e.g., 85% or more, 90% or more, 95% or more, or 100% identity) with the nucleotide sequence: GTTAA $(n)_{x1}$ GTTAA $(n)_{x2}$ TA $(n)_2$ TTTG $(n)_{x3}$ GAA (SEQ ID NO: 401) (where the percent identity is calculated using only the defined nucleotides of the sequence set forth in SEQ ID NO: 401), where:
  (1) x1 can be an integer in a range of from 3-7 (e.g., in some cases x1 is an integer in a range of from 4-6, in some cases x1 is 4, and in some cases, x1 is 6);
  (2) x2 can be an integer in a range of from 36-38 (e.g., in some cases x2 is 37); and
  (3) x3 can be an integer in a range of from 4-12 (e.g., in some cases x3 is an integer in a range of from 7-11, in some cases x3 is an integer in a range of from 4-7, in some cases x3 is an integer in a range of from 6-8, in some cases x3 is 7, in some cases x3 is 11).

In some cases, x1 is an integer in a range of from 3-7, x2 is an integer in a range of from 36-38, and x3 is an integer in a range of from 4-12. In some cases, x1 is an integer in a range of from 3-7, x2 is an integer in a range of from 36-38, and x3 is an integer in a range of from 4-7. In some cases, x1 is an integer in a range of from 3-7, x2 is an integer in a range of from 36-38, and x3 is an integer in a range of from 7-11. In some cases, x1 is an integer in a range of from 4-6, x2 is in integer in a range of from 36-38, and x3 is an integer in a range of from 6-8. In some cases, x1 is an integer in a range of from 4-6, x2 is in integer in a range of from 36-38, and x3 is 7. In some cases, x1 is an integer in a range of from 3-7, x2 is 37, and x3 is 7. In some cases, x1 is an integer in a range of from 4-6, x2 is 37, and x3 is 7. In some cases, x1 is an integer in a range of from 3-7, x2 is 37, and x3 is an integer in a range of from 7-11. In some cases, x1 is an integer in a range of from 4-6, x2 is 37, and x3 is an integer in a range of from 7-11.

In some embodiments, a promoter of a subject nucleic acid includes the nucleotide sequence: GTTAA $(n)_{x1}$ GTTAA $(n)_{x2}$ TTG $(n)_{x3}$ TA $(n)_2$ TTTG (SEQ ID NO: 402) where:
  (1) x1 can be an integer in a range of from 3-7 (e.g., in some cases x1 is an integer in a range of from 4-6, in some cases x1 is 4, and in some cases, x1 is 6);
  (2) x2 can be an integer in a range of from 14-16 (e.g., in some cases x2 is 15); and
  (3) x3 can be an integer in a range of from 18-20 (e.g., in some cases x3 is 19).

In some cases, x1 is an integer in a range of from 3-7, x2 is an integer in a range of from 14-16, and x3 is an integer in a range of from 18-20. In some cases, x1 is an integer in a range of from 4-6, x2 is an integer in a range of from 14-16, and x3 is an integer in a range of from 18-20. In some cases, x1 is an integer in a range of from 3-7, x2 is 15, and x3 is 19. In some cases, x1 is an integer in a range of from 4-6, x2 is 15, and x3 is 19.

In some embodiments, a promoter of a subject nucleic acid includes a nucleotide sequence having 80% or more identity (e.g., 85% or more, 90% or more, 95% or more, or 100% identity) with the nucleotide sequence: GTTAA $(n)_{x1}$ GTTAA $(n)_{x2}$ TTG $(n)_{x3}$ TA $(n)_2$ TTTG (SEQ ID NO: 402) (where the percent identity is calculated using only the defined nucleotides of the sequence set forth in SEQ ID NO: 402), where:
  (1) x1 can be an integer in a range of from 3-7 (e.g., in some cases x1 is an integer in a range of from 4-6, in some cases x1 is 4, and in some cases, x1 is 6);
  (2) x2 can be an integer in a range of from 14-16 (e.g., in some cases x2 is 15); and
  (3) x3 can be an integer in a range of from 18-20 (e.g., in some cases x3 is 19).

In some cases, x1 is an integer in a range of from 3-7, x2 is an integer in a range of from 14-16, and x3 is an integer in a range of from 18-20.

In some cases, x1 is an integer in a range of from 4-6, x2 is an integer in a range of from 14-16, and x3 is an integer in a range of from 18-20. In some cases, x1 is an integer in a range of from 3-7, x2 is 15, and x3 is 19. In some cases, x1 is an integer in a range of from 4-6, x2 is 15, and x3 is 19.

In some embodiments, a promoter of a subject nucleic acid includes the nucleotide sequence: GTTAA $(n)_{x1}$ GTTAAA $(n)_{x2}$ TTG $(n)_{x3}$ TA $(n)_2$ TTTG (SEQ ID NO: 404) where:
  (1) x1 can be an integer in a range of from 3-7 (e.g., in some cases x1 is an integer in a range of from 4-6, in some cases x1 is 4, and in some cases, x1 is 6);
  (2) x2 can be an integer in a range of from 14-16 (e.g., in some cases x2 is 15); and
  (3) x3 can be an integer in a range of from 18-20 (e.g., in some cases x3 is 19).

In some cases, x1 is an integer in a range of from 3-7, x2 is an integer in a range of from 14-16, and x3 is an integer in a range of from 18-20. In some cases, x1 is an integer in a range of from 4-6, x2 is an integer in a range of from 14-16, and x3 is an integer in a range of from 18-20. In some cases, x1 is an integer in a range of from 3-7, x2 is 15, and x3 is 19. In some cases, x1 is an integer in a range of from 4-6, x2 is 15, and x3 is 19.

In some embodiments, a promoter of a subject nucleic acid includes a nucleotide sequence having 80% or more identity (e.g., 85% or more, 90% or more, 95% or more, or 100% identity) with the nucleotide sequence: GTTAA $(n)_{x1}$ GTTAAA $(n)_{x2}$ TTG $(n)_{x3}$ TA $(n)_2$ TTTG (SEQ ID NO: 404) (where the percent identity is calculated using only the defined nucleotides of the sequence set forth in SEQ ID NO: 404), where:
  (1) x1 can be an integer in a range of from 3-7 (e.g., in some cases x1 is an integer in a range of from 4-6, in some cases x1 is 4, and in some cases, x1 is 6);
  (2) x2 can be an integer in a range of from 14-16 (e.g., in some cases x2 is 15); and
  (3) x3 can be an integer in a range of from 18-20 (e.g., in some cases x3 is 19).

In some cases, x1 is an integer in a range of from 3-7, x2 is an integer in a range of from 14-16, and x3 is an integer in a range of from 18-20.

In some cases, x1 is an integer in a range of from 4-6, x2 is an integer in a range of from 14-16, and x3 is an integer in a range of from 18-20. In some cases, x1 is an integer in a range of from 3-7, x2 is 15, and x3 is 19. In some cases, x1 is an integer in a range of from 4-6, x2 is 15, and x3 is 19.

In some embodiments, a promoter of a subject nucleic acid includes the nucleotide sequence: GTTAA $(n)_{x1}$ GTTAA $(n)_{x2}$ TTG $(n)_{x3}$ TA $(n)_2$ TTTG $(n)_{x4}$ GAA (SEQ ID NO: 403) where:
  (1) x1 can be an integer in a range of from 3-7 (e.g., in some cases x1 is an integer in a range of from 4-6, in some cases x1 is 4, and in some cases, x1 is 6);
  (2) x2 can be an integer in a range of from 14-16 (e.g., in some cases x2 is 15);
  (3) x3 can be an integer in a range of from 18-20 (e.g., in some cases x3 is 19); and
  (4) x4 can be an integer in a range of from 4-12 (e.g., in some cases x4 is an integer in a range of from 7-11, in some cases x4 is an integer in a range of from 4-7, in some cases x4 is an integer in a range of from 6-8, in some cases x4 is 7, in some cases x4 is 11).

In some cases, x1 is an integer in a range of from 3-7, x2 is an integer in a range of from 14-16, x3 is an integer in a range of from 18-20, and x4 is an integer in a range of from 4-12. In some cases, x1 is an integer in a range of from 3-7, x2 is an integer in a range of from 14-16, x3 is an integer in a range of from 18-20, and x4 is an integer in a range of from 4-7. In some cases, x1 is an integer in a range of from 3-7, x2 is an integer in a range of from 14-16, x3 is an integer in a range of from 18-20, and x4 is an integer in a range of from 7-11. In some cases, x1 is an integer in a range of from 4-6, x2 is an integer in a range of from 14-16, x3 is an integer in a range of from 18-20, and x4 is an integer in a range of from 6-8. In some cases, x1 is an integer in a range of from 4-6, x2 is an integer in a range of from 14-16, x3 is an integer in a range of from 18-20, and x4 is 7. In some cases, x1 is an integer in a range of from 3-7, x2 is 15, x3 is 19, and x4 is an integer in a range of from 7-11. In some cases, x1 is an integer in a range of from 3-7, x2 is 15, x3 is 19, and x4 is 7. In some cases, x1 is an integer in a range of from 4-6, x2 is 15, x3 is 19, and x4 is an integer in a range of from 7-11. In some cases, x1 is an integer in a range of from 4-6, x2 is 15, x3 is 19, and x4 is 7.

In some embodiments, a promoter of a subject nucleic acid includes a nucleotide sequence having 80% or more identity (e.g., 85% or more, 90% or more, 95% or more, or 100% identity) with the nucleotide sequence: GTTAA $(n)_{x1}$ GTTAA $(n)_{x2}$ TTG $(n)_{x3}$ TA $(n)_2$ TTTG $(n)_{x4}$ GAA (SEQ ID NO: 403) (where the percent identity is calculated using only the defined nucleotides of the sequence set forth in SEQ ID NO: 403), where:
  (1) x1 can be an integer in a range of from 3-7 (e.g., in some cases x1 is an integer in a range of from 4-6, in some cases x1 is 4, and in some cases, x1 is 6);
  (2) x2 can be an integer in a range of from 14-16 (e.g., in some cases x2 is 15);
  (3) x3 can be an integer in a range of from 18-20 (e.g., in some cases x3 is 19); and
  (4) x4 can be an integer in a range of from 4-12 (e.g., in some cases x4 is an integer in a range of from 7-11, in some cases x4 is an integer in a range of from 4-7, in some cases x4 is an integer in a range of from 6-8, in some cases x4 is 7, in some cases x4 is 11).

In some cases, x1 is an integer in a range of from 3-7, x2 is an integer in a range of from 14-16, x3 is an integer in a range of from 18-20, and x4 is an integer in a range of from 4-12. In some cases, x1 is an integer in a range of from 3-7, x2 is an integer in a range of from 14-16, x3 is an integer in a range of from 18-20, and x4 is an integer in a range of from 4-7. In some cases, x1 is an integer in a range of from 3-7, x2 is an integer in a range of from 14-16, x3 is an integer in a range of from 18-20, and x4 is an integer in a range of from 7-11. In some cases, x1 is an integer in a range of from 4-6, x2 is an integer in a range of from 14-16, x3 is an integer in a range of from 18-20, and x4 is an integer in a range of from 6-8. In some cases, x1 is an integer in a range of from 4-6, x2 is an integer in a range of from 14-16, x3 is an integer in a range of from 18-20, and x4 is 7. In some cases, x1 is an integer in a range of from 3-7, x2 is 15, x3 is 19, and x4 is an integer in a range of from 7-11. In some cases, x1 is an integer in a range of from 3-7, x2 is 15, x3 is 19, and x4 is 7. In some cases, x1 is an integer in a range of from 4-6, x2 is 15, x3 is 19, and x4 is an integer in a range of from 7-11. In some cases, x1 is an integer in a range of from 4-6, x2 is 15, x3 is 19, and x4 is 7.

In some embodiments, a promoter of a subject nucleic acid includes a nucleotide sequence of the group of nucleotide sequences presented in Table 13, wherein "n" represents a nucleotide that is independently selected from A, C, G, and T. In some embodiments, a promoter of a subject nucleic acid may include a nucleotide sequence having 80% or more identity to a nucleotide sequence presented in Table 13, wherein the percent identity is calculated using only the defined nucleotides. In some cases, the promoter may include a nucleotide sequences having 85% or more, 90% or more, 95% or more, or 100% identity to a nucleotide sequence presented in Table 13.

TABLE 13

Consensus promoter sequences of the disclosure.
Consensus Sequence

GTTAA(n)$_{4-7}$GTTAA(n)$_{12-16}$TTG(n)$_{18-22}$TA(n)$_2$TTTG
(SEQ ID NO: 492)

GTTAA(n)$_{4-8}$GTTAA(n)$_{12-16}$TTG(n)$_{18-22}$TA(n)$_2$TTTG
(SEQ ID NO: 493)

GTTAA(n)$_{3-7}$GTTAA(n)$_{12-16}$TTG(n)$_{18-22}$TA(n)$_2$TTTG
(SEQ ID NO: 494)

GTTAA(n)$_{4-7}$GTTAA(n)$_{12-16}$TTG(n)$_{18-22}$TA(n)$_2$TTGC
(SEQ ID NO: 495)

GTTAA(n)$_{3-7}$GTTAA(n)$_{36-38}$TA(n)$_2$TTTG
(SEQ ID NO: 496)

GTTAA(n)$_{4-7}$GTTAA(n)$_{36-38}$TA(n)$_2$TTTG
(SEQ ID NO: 497)

GTTAA(n)$_{4-7}$GTTAA(n)$_{34-38}$TA(n)$_2$TTTG
(SEQ ID NO: 498)

GTTAA(n)$_{4-7}$GTTAA(n)$_{36-39}$TA(n)$_2$TTTG
(SEQ ID NO: 499)

GTTAA(n)$_{4-7}$GTTAA(n)$_{36-39}$TA(n)$_2$TTTGC
(SEQ ID NO: 500)

GTTAA(n)$_{0-20}$GTTAA(n)$_{10-60}$TA(n)$_2$TTTG
(SEQ ID NO: 501)

TTAA(n)$_{0-10}$TTAA(n)$_{30-50}$TA(n)$_2$TTTG
(SEQ ID NO: 502)

GTTAA(n)$_{4-7}$GTTAA
(SEQ ID NO: 503)

GTTAA(n)$_{48-54}$TTTG
(SEQ ID NO: 504)

GTTAA(n)$_{36-38}$TA
(SEQ ID NO: 505)

GTTAA(n)$_{40-42}$TTTG
(SEQ ID NO: 506)

GTTAA(n)$_{3-7}$GTTAA(n)$_{36-38}$TA
(SEQ ID NO: 507)

GTTAA(n)$_{3-7}$GTTAA(n)$_{40-42}$TTTG
(SEQ ID NO: 508)

GTTAA(n)$_{44-50}$TA(n)$_2$TTTG
(SEQ ID NO: 509)

GTTAA(n)$_{36-38}$TA(n)$_2$TTTG
(SEQ ID NO: 510)

The above sequences (SEQ ID NOs: 400-404) are found in SEQ ID NOs: 8, 388, 393, 394, 397, and 406-407 (see Table 6, Table 7, and FIG. 20). For example see FIG. 20 for an alignment of two identified promoter sequences and FIG. 2 (panel d) which depicts results from mutagenesis experiments throughout a promoter sequence of SEQ ID NO: 8.

In some cases, a promoter of a subject nucleic acid satisfies one or more of the formulas above (e.g., having X % identity to any of SEQ ID NOs: 400-404) and also has identity with a *Bacteroides* phage promoter sequence set forth herein (for examples, see SEQ ID NOs: 1-8, 151-364, 381-388, and 405-407). Thus, in some cases, a promoter of a subject nucleic acid includes a nucleotide sequence having: (1) X % identity to any of SEQ ID NOs: 400-404; and/r (2) X % identity with a promoter sequence set forth herein (see the paragraphs below for examples). As one illustrative example, in some cases, a promoter of a subject nucleic acid includes a nucleotide sequence having: (1) 80% or more identity with the sequence set forth in any one of SEQ ID NOs: 400-404; and/or (2) 80% or more identity with the promoter sequence set forth in any of SEQ ID NOs: 388 and 407. Any combination of the above (X % identity to any of SEQ ID NOs: 400-404) with the below (e.g., X % identity with a promoter sequence set forth herein, e.g., as a substitute for "388 and 407" in the previous sentence) is suitable, and any combination can be separated by an "and/or" as exemplified in this paragraph.

Examples of promoter sequences operable in *Bacteroides* cells include, but are not limited to those presented in Tables 4-7. For example, in some cases, the promoter of a subject nucleic acid includes a nucleotide sequence having 75% or more identity (e.g., 80% or more, 85% or more, 90% or more, 95% or more, 98% or more, 99% or more, 99.5% or more, 99.8% or more, or 100% identity) with the *Bacteroides* phage promoter sequence set forth as SEQ ID NO: 8. In some cases, the promoter includes a nucleotide sequence having 90% or more identity (e.g., 92% or more, 95% or more, 98% or more, 99% or more, 99.5% or more, 99.8% or more, or 100% identity) with the *Bacteroides* phage promoter sequence set forth as SEQ ID NO: 8.

In some cases, the promoter of a subject nucleic acid includes a nucleotide sequence having 75% or more identity (e.g., 80% or more, 85% or more, 90% or more, 95% or more, 98% or more, 99% or more, 99.5% or more, 99.8% or more, or 100% identity) with the *Bacteroides* phage promoter sequence set forth as SEQ ID NO: 388. In some cases, the promoter includes a nucleotide sequence having 90% or more identity (e.g., 92% or more, 95% or more, 98% or more, 99% or more, 99.5% or more, 99.8% or more, or 100% identity) with the *Bacteroides* phage promoter sequence set forth as SEQ ID NO: 388.

In some cases, the promoter of a subject nucleic acid includes a nucleotide sequence having 75% or more identity (e.g., 80% or more, 85% or more, 90% or more, 95% or more, 98% or more, 99% or more, 99.5% or more, 99.8% or more, or 100% identity) with the *Bacteroides* phage promoter sequence set forth as SEQ ID NO: 407 (or in some cases SEQ ID NO: 406). In some cases, the promoter includes a nucleotide sequence having 90% or more identity (e.g., 92% or more, 95% or more, 98% or more, 99% or more, 99.5% or more, 99.8% or more, or 100% identity) with the *Bacteroides* phage promoter sequence set forth as SEQ ID NO: 407 (or in some cases SEQ ID NO: 406).

In some cases, the promoter of a subject nucleic acid includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 388 and 406 (or in some cases SEQ ID NOs: 388 and 407). In some cases, the promoter of a subject nucleic acid includes a nucleotide sequence having 90% or more identity (e.g., 92% or more, 95% or more, 98% or more, 99% or more, 99.5% or more, 99.8% or more, or 100% identity) with the promoter sequence set forth in any of SEQ ID NOs: 388 and 406 (or in some cases SEQ ID NOs: 388 and 407). In some cases, the promoter of a subject nucleic acid includes the promoter sequence set forth in any of SEQ ID NOs: 388 and 406 (or in some cases SEQ ID NOs: 388 and 407).

In some cases, the promoter of a subject nucleic acid includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-8. In some cases, the promoter of a subject nucleic acid includes a nucleotide sequence having 90% or more identity (e.g., 92% or more, 95% or more, 98% or more, 99% or more, 99.5% or more, 99.8% or more, or 100% identity) with the promoter sequence set forth in any of SEQ ID NOs: 1-8. In some cases, the promoter of a subject nucleic acid includes the promoter sequence set forth in any of SEQ ID NOs: 1-8.

In some cases, the promoter of a subject nucleic acid includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-8 and 381-388. In some cases, the promoter of a subject nucleic acid includes a nucleotide sequence having 90% or more identity (e.g., 92% or more, 95% or more, 98% or more, 99% or more, 99.5% or more, 99.8% or more, or 100% identity) with the promoter sequence set forth in any of SEQ ID NOs: 1-8 and 381-388. In some cases, the promoter of a subject nucleic acid includes the promoter sequence set forth in any of SEQ ID NOs: 1-8 and 381-388.

In some cases, the promoter of a subject nucleic acid includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-8, 151-364, and 381-388. In some cases, the promoter of a subject nucleic acid includes a nucleotide sequence having 90% or more identity (e.g., 92% or more, 95% or more, 98% or more, 99% or more, 99.5% or more, 99.8% or more, or 100% identity) with the promoter sequence set forth in any of SEQ ID NOs: 1-8, 151-364, and 381-388. In some cases, the promoter of a subject nucleic acid includes the promoter sequence set forth in any of SEQ ID NOs: 1-8, 151-364, and 381-388.

In some cases, the promoter of a subject nucleic acid is a synthetic promoter (i.e., the promoter is not a naturally occurring promoter, e.g., the promoter includes a nucleotide sequence having at least one mutation relative to a corresponding wild type promoter). In some cases, the promoter of a subject nucleic acid is a synthetic promoter that includes a nucleotide sequence having 75% or more identity (e.g., 80% or more, 85% or more, 90% or more, 95% or more, 98% or more, 99% or more, 99.5% or more, or 99.8% or more) with the *Bacteroides* phage promoter sequence set forth as SEQ ID NO: 8. In some cases, the promoter of a subject nucleic acid is a synthetic promoter that includes a nucleotide sequence having 90% or more identity (e.g., 92% or more, 95% or more, 98% or more, 99% or more, 99.5% or more, or 99.8% or more) with the *Bacteroides* phage promoter sequence set forth as SEQ ID NO: 8.

In some cases, the promoter of a subject nucleic acid is a synthetic promoter (i.e., the promoter is not a naturally occurring promoter, e.g., the promoter includes a nucleotide sequence having at least one mutation relative to a corresponding wild type promoter). In some cases, the promoter of a subject nucleic acid is a synthetic promoter that includes a nucleotide sequence having 75% or more identity (e.g., 80% or more, 85% or more, 90% or more, 95% or more, 98% or more, 99% or more, 99.5% or more, or 99.8% or more) with the *Bacteroides* phage promoter sequence set forth as SEQ ID NO: 388. In some cases, the promoter of a subject nucleic acid is a synthetic promoter that includes a nucleotide sequence having 90% or more identity (e.g., 92% or more, 95% or more, 98% or more, 99% or more, 99.5% or more, or 99.8% or more) with the *Bacteroides* phage promoter sequence set forth as SEQ ID NO: 388.

In some cases, the promoter of a subject nucleic acid is a synthetic promoter (i.e., the promoter is not a naturally occurring promoter, e.g., the promoter includes a nucleotide sequence having at least one mutation relative to a corresponding wild type promoter). In some cases, the promoter of a subject nucleic acid is a synthetic promoter that includes a nucleotide sequence having 75% or more identity (e.g., 80% or more, 85% or more, 90% or more, 95% or more, 98% or more, 99% or more, 99.5% or more, or 99.8% or more) with the *Bacteroides* phage promoter sequence set forth as SEQ ID NO: 407 (or in some cases SEQ ID NO: 406). In some cases, the promoter of a subject nucleic acid is a synthetic promoter that includes a nucleotide sequence having 90% or more identity (e.g., 92% or more, 95% or more, 98% or more, 99% or more, 99.5% or more, or 99.8% or more) with the *Bacteroides* phage promoter sequence set forth as SEQ ID NO: 407 (or in some cases SEQ ID NO: 406).

In some cases, the promoter of a subject nucleic acid is a synthetic promoter that includes a nucleotide sequence having 75% or more identity (e.g., 80% or more, 85% or more, 90% or more, 95% or more, 98% or more, 99% or more, 99.5% or more, or 99.8% or more) with the promoter sequence set forth in any of SEQ ID NOs: 1-8. In some cases, the promoter of a subject nucleic acid is a synthetic promoter that includes a nucleotide sequence having 90% or more identity (e.g., 92% or more, 95% or more, 98% or more, 99% or more, 99.5% or more, or 99.8% or more) with the promoter sequence set forth in any of SEQ ID NOs: 1-8.

In some cases, the promoter of a subject nucleic acid is a synthetic promoter that includes a nucleotide sequence having 75% or more identity (e.g., 80% or more, 85% or more, 90% or more, 95% or more, 98% or more, 99% or more, 99.5% or more, or 99.8% or more) with the promoter sequence set forth in any of SEQ ID NOs: 388 and 406 (or in some cases SEQ ID NOs: 388 and 407). In some cases, the promoter of a subject nucleic acid is a synthetic promoter that includes a nucleotide sequence having 90% or more identity (e.g., 92% or more, 95% or more, 98% or more, 99% or more, 99.5% or more, or 99.8% or more) with the promoter sequence set forth in any of SEQ ID NOs: 388 and 406 (or in some cases SEQ ID NOs: 388 and 407).

In some cases, the promoter of a subject nucleic acid is a synthetic promoter that includes a nucleotide sequence having 75% or more identity (e.g., 80% or more, 85% or more, 90% or more, 95% or more, 98% or more, 99% or more, 99.5% or more, or 99.8% or more) with the promoter sequence set forth in any of SEQ ID NOs: 1-8 and 381-388. In some cases, the promoter of a subject nucleic acid is a synthetic promoter that includes a nucleotide sequence having 90% or more identity (e.g., 92% or more, 95% or more, 98% or more, 99% or more, 99.5% or more, or 99.8% or more) with the promoter sequence set forth in any of SEQ ID NOs: 1-8 and 381-388.

In some cases, the promoter of a subject nucleic acid is a synthetic promoter that includes a nucleotide sequence having 75% or more identity (e.g., 80% or more, 85% or more, 90% or more, 95% or more, 98% or more, 99% or more, 99.5% or more, 99.8% or more, or 100% identity) with the synthetic promoter sequence set forth in any of SEQ ID NOs: 1-7. In some cases, the promoter of a subject nucleic acid is a synthetic promoter that includes a nucleotide sequence having 90% or more identity (e.g., 92% or more, 95% or more, 98% or more, 99% or more, 99.5% or more, 99.8% or more, or 100% identity) with the synthetic promoter sequence set forth in any of SEQ ID NOs: 1-7. In some cases, the promoter of a subject nucleic acid is a synthetic promoter that includes the nucleotide sequence set forth in any of SEQ ID NOs: 1-7.

In some cases, the promoter of a subject nucleic acid is a synthetic promoter that includes a nucleotide sequence having 75% or more identity (e.g., 80% or more, 85% or more, 90% or more, 95% or more, 98% or more, 99% or more, 99.5% or more, 99.8% or more, or 100% identity) with the synthetic promoter sequence set forth in any of SEQ ID NOs: 381-387. In some cases, the promoter of a subject nucleic acid is a synthetic promoter that includes a nucleotide sequence having 90% or more identity (e.g., 92% or more, 95% or more, 98% or more, 99% or more, 99.5% or more, 99.8% or more, or 100% identity) with the synthetic promoter sequence set forth in any of SEQ ID NOs: 381-387. In some cases, the promoter of a subject nucleic acid is a synthetic promoter that includes the nucleotide sequence set forth in any of SEQ ID NOs: 381-387.

In some cases, the promoter of a subject nucleic acid is a synthetic promoter that includes a nucleotide sequence having 75% or more identity (e.g., 80% or more, 85% or more, 90% or more, 95% or more, 98% or more, 99% or more, 99.5% or more, 99.8% or more, or 100% identity) with the synthetic promoter sequence set forth in any of SEQ ID NOs: 1-7 and 381-387. In some cases, the promoter of a subject nucleic acid is a synthetic promoter that includes a nucleotide sequence having 90% or more identity (e.g., 92% or more, 95% or more, 98% or more, 99% or more, 99.5% or more, 99.8% or more, or 100% identity) with the synthetic promoter sequence set forth in any of SEQ ID NOs: 1-7 and 381-387. In some cases, the promoter of a subject nucleic acid is a synthetic promoter that includes the nucleotide sequence set forth in any of SEQ ID NOs: 1-7 and 381-387.

In some cases, the promoter of a subject nucleic acid is a synthetic promoter that includes a nucleotide sequence having 75% or more identity (e.g., 80% or more, 85% or more, 90% or more, 95% or more, 98% or more, 99% or more, 99.5% or more, 99.8% or more, or 100% identity) with the synthetic promoter sequence set forth in any of SEQ ID NOs: 1-7, 151-364, and 381-387. In some cases, the promoter of a subject nucleic acid is a synthetic promoter that includes a nucleotide sequence having 90% or more identity (e.g., 92% or more, 95% or more, 98% or more, 99% or more, 99.5% or more, 99.8% or more, or 100% identity) with the synthetic promoter sequence set forth in any of SEQ ID NOs: 1-7, 151-364, and 381-387. In some cases, the promoter of a subject nucleic acid is a synthetic promoter that includes the nucleotide sequence set forth in any of SEQ ID NOs: 1-7, 151-364, and 381-387.

TABLE 4

Promoters and ribosome binding site (RBS) sequences of the disclosure.
"sp": synthetic promoter; "sr": synthetic RBS. SEQ ID NOs: 1-7 are synthetic promoters
(mutation of wild type phage promoter). SEQ ID NO: 8 is a wild type phage promoter. SEQ ID
NOs: 10-18 are synthetic RBSs (i.e., include an altered sequence relative to wild type phage
RBSs). SEQ ID NOs: 20-83 are promoter/RBS combinations from promoters of SEQ ID NOs
1-8 paired with RBSs of SEQ ID NOs 11-18 (64 combinations, promoter/RBS, length of each
combination is 200 nucleotides (nt)). SEQ ID NOs: 28-83 are promoter/RBS combinations
from promoters of SEQ ID NOs 2-8 paired with RBSs of SEQ ID NOs 11-18 (56
combinations, promoter/RBS, length of each combination is 200 nucleotides (nt)). SEQ ID
NOs: 151-364 are additional synthetic promoters. SEQ ID NOs: 381-388 are truncated by 26
nt at the 5' end and 3 nt at the 3' end and relative to SEQ ID NOs: 1-8, respectively (see -74
+17 of Table 6 and -100 +20 of Table 7).

| SEQ ID NO: | Description | sequence | Length (nt) |
|---|---|---|---|
| Promoters | | | |
| 1 | sp1 (P_BfP3E1) | caattgggctaccttttttttgtaaaaaaaaacccgcccctgacagggcgggg ttttttttttcacttgaactttcaaataatgttcttataaaaccagtgtcgaaagaaac aaagtag | 120 |
| 2 | sp2 (P_BfP2E2) | caattgggctaccttttttttgtaaaaaaaaacccgcccctgacagggcgggg ttttttttttcacttgaactttcaaataatgttcttatatatgcagtgtcgaaagaaaca aagtag | 120 |
| 3 | sp3 (P_BfP2E3) | caattgggctaccttttttttgttttgtttgcaatggttaatctattgttaaaatttaaagtt tcacttgaactttcaaataatgttcttatatgtgcagtgtcgaaagaaacaaagta g | 120 |
| 4 | sp4 (P_BfP1E4) | caattgggctaccttttttttgttttgtttgcaatggttaatctattgttaacatttaaagtt tcacttgaactttcaaataatgttcttatattttcagtgtcgaaagaaacaaagtag g | 120 |
| 5 | sp5 (P_BfP5E4) | caattgggctaccttttttttgttttgtttgcaatggttaatctattgttaaaatttaaagtt tcacttgaactttcaaataatgttcttctatttgcagtgtcgaaagaaacaaagta g | 120 |
| 6 | sp6 (P_BfP2E5) | caattgggctaccttttttttgattgtttgcaatggttaatctattgttaaaatttaaagtt tcacttgaactttcaaataatgttcttatatttccagtgtcgaaagaaacaaagta g | 120 |
| 7 | sp7 (P_BfP4E5) | caattgggctaccttttttttgttttgtttgcaatggttaatctattgttgaaatttaaagtt tcacttgaactttcaaataatgttcttatatttgcagtgtcgaaagaaacaaagta g | 120 |
| 8 | WT phage promoter (P6) (P_BfP1E6) (-100, +20) | caattgggctaccttttttttgttttgtttgcaatggttaatctattgttaaaatttaaagtt tcacttgaactttcaaataatgttcttatatttgcagTgtcgaaagaaacaaagta g | 120 |
| 406 | WT phage promoter (P5) (-94, +20) | gagtaactacgataataaagtgataattcaatgttaaaacagttaatgcacgtt aaagtatttgctactgagaaatatatccgtatatttgcagcgtagaagttattact aaca | 114 |
| DNA encoding Ribosomal Binding Sequences (RBSs) | | | |
| 10 | sr (synthetic RBS) | gactgatctatggattcaaaaaaatttaaaataatg | 36 |
| 11 | sr1 (RBS1) | gactgatcggcgcgactcacgcgccgatcagtaatg | 36 |
| 12 | sr2 (RBS2) | gactgatcaggaagagtaaaaaatattaaaataatg | 36 |
| 13 | sr3 (RBS3) | gactgatctctgggtgaataaaatttataataatg | 36 |
| 14 | sr4 (RBS4) | gactgatcccccattctattaaattttagaataatg | 36 |
| 15 | sr5 (RBS5) | gactgatcggtgttagctttaaatattagaataatg | 36 |
| 16 | sr6 (RBS6) | gactgatctagcactcttaaaaaaattaaaataatg | 36 |
| 17 | sr7 (RBS7) | gactgatcgtaatctttaaaaaaaataaaataatg | 36 |
| 18 | sr8 (RBS8) | gactgatcgtccatcaattaaaatttaaaataatg | 36 |

In some embodiments, a subject nucleic acid includes, upstream (5') of the promoter, a terminator sequence. For example, a terminator sequence located upstream can be used to reduce the chance that the operably linked sequence downstream (3') of the subject promoter is not transcribed as part of a transcript from an upstream promoter. In other words, a terminator sequence can be positioned 5' of a subject promoter as an element that can terminate transcription from an upstream promoter. Any convenient terminator sequence can be used. When present in the working examples below, the terminator sequence gataaaacgaaaggctcagtcgaaagactgggcctttcgtttta (SEQ ID NO: 409) was used.

In some cases, a subject nucleic acid includes a terminator sequence downstream (3) of a subject nucleotide sequence of interest in order to terminate transcription from the subject promoter (the promoter that is operably linked to the nucleotide sequence of interest).

Ribosomal Binding Site (RBS)

In some embodiments, a subject nucleic acid includes a nucleotide sequence encoding a ribosomal binding site (RBS), e.g., where the sequence encoding the RBS is operably linked to the promoter and is positioned between the promoter and the nucleotide sequence of interest. As such, in some cases, the RBS is positioned 3' of the promoter. In some cases, the RBS is positioned 5' of the nucleotide sequence of interest. In some cases, the RBS is positioned 3' of the promoter and 5' of the nucleotide sequence of interest.

Examples of nucleotide sequences encoding suitable RBS sequences include, but are not limited to those presented in Table 4. For example, in some cases, the sequence encoding an RBS of a subject nucleic acid includes a nucleotide sequence having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 10-18. In some cases, the sequence encoding an RBS of a subject nucleic acid includes a nucleotide sequence having 90% or more identity (e.g., 92% or more, 95% or more, 98% or more, 99% or more, 99.5% or more, 99.8% or more, or 100% identity) with the nucleotide sequence set forth in any of SEQ ID NOs: 10-18. In some cases, the sequence encoding an RBS of a subject nucleic acid includes the nucleotide sequence set forth in any of SEQ ID NOs: 10-18.

In some cases, the sequence encoding an RBS of a subject nucleic acid includes a nucleotide sequence having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 11-18. In some cases, the sequence encoding an RBS of a subject nucleic acid includes a nucleotide sequence having 90% or more identity (e.g., 92% or more, 95% or more, 98% or more, 99% or more, 99.5% or more, 99.8% or more, or 100% identity) with the nucleotide sequence set forth in any of SEQ ID NOs: 11-18. In some cases, the sequence encoding an RBS of a subject nucleic acid includes the nucleotide sequence set forth in any of SEQ ID NOs: 11-18.

In some cases, the RBS of a subject nucleic acid is a synthetic RBS (i.e., includes a mutation relative to a corresponding naturally occurring RBS) and the sequence encoding the synthetic RBS includes a nucleotide sequence having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 11-18. In some cases, the RBS of a subject nucleic acid is a synthetic RBS (i.e., includes a mutation relative to a corresponding naturally occurring RBS) and the sequence encoding the synthetic RBS includes a nucleotide sequence having 90% or more identity (e.g., 92% or more, 95% or more, 98% or more, 99% or more, 99.5% or more, 99.8% or more, or 100% identity) with the nucleotide sequence set forth in any of SEQ ID NOs: 11-18. In some cases, the sequence encoding an RBS of a subject nucleic acid includes the nucleotide sequence set forth in any of SEQ ID NOs: 11-18.

In some cases, the RBS of a subject nucleic acid is a synthetic RBS (i.e., includes a mutation relative to a corresponding naturally occurring RBS) and the sequence encoding the synthetic RBS includes a nucleotide sequence having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 12-18. In some cases, the RBS of a subject nucleic acid is a synthetic RBS (i.e., includes a mutation relative to a corresponding naturally occurring RBS) and the sequence encoding the synthetic RBS includes a nucleotide sequence having 90% or more identity (e.g., 92% or more, 95% or more, 98% or more, 99% or more, 99.5% or more, 99.8% or more, or 100% identity) with the nucleotide sequence set forth in any of SEQ ID NOs: 12-18. In some cases, the sequence encoding an RBS of a subject nucleic acid includes the nucleotide sequence set forth in any of SEQ ID NOs: 12-18.

Promoter/RBS Combinations

Any of the above described promoters can be used in combination with any of the above described RBSs. For example, in some cases, a subject nucleic acid includes a promoter of Table 4 and an RBS of Table 4. In some cases, a subject nucleic acid includes a promoter of Table 4, Table 5, Table 6, or Table 7, and an RBS of Table 4.

In some embodiments, a subject nucleic acid includes a promoter that includes a nucleotide sequence of a wild type (i.e., naturally occurring) promoter from a phage (e.g., a *Bacteroides* phage, i.e., a phage that infects *Bacteroides* cells), and an RBS (e.g., a wild type RBS, a synthetic RBS, an RBS of Table 4, and the like). In some cases, a subject nucleic acid includes a promoter that includes the *Bacteroides* phage promoter sequence set forth in any of SEQ ID NOs: 400-404; and an RBS (e.g., a wild type RBS, a synthetic RBS, an RBS of Table 4, and the like). In some cases, a subject nucleic acid includes a promoter that includes the *Bacteroides* phage promoter sequence set forth in any of SEQ ID NOs: 8, 388, 406, and 407; and an RBS (e.g., a wild type RBS, a synthetic RBS, an RBS of Table 4, and the like). In some cases, a subject nucleic acid includes a promoter that includes the *Bacteroides* phage promoter sequence set forth in any of SEQ ID NOs: 388 and 407; and an RBS (e.g., a wild type RBS, a synthetic RBS, an RBS of Table 4, and the like). In some cases, a subject nucleic acid includes a promoter that includes the *Bacteroides* phage promoter sequence set forth in SEQ ID NO: 8; and an RBS (e.g., a wild type RBS, a synthetic RBS, an RBS of Table 4, and the like). In some cases, a subject nucleic acid includes a promoter that includes the *Bacteroides* phage promoter sequence set forth in SEQ ID NO: 406; and an RBS (e.g., a wild type RBS, a synthetic RBS, an RBS of Table 4, and the like). In some cases, a promoter of a subject nucleic acid is a synthetic promoter (i.e., not naturally occurring, e.g., a sequence that has at least one mutation relative to a corresponding wild type promoter sequence); and an RBS (e.g., a wild type RBS, a synthetic RBS, an RBS of Table 4, and the like).

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 2-8; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 10-18. In some cases, a subject nucleic acid includes a promoter that includes a nucleotide sequence with the promoter sequence set forth in any of SEQ ID NOs: 2-8; and a nucleotide sequence, encoding an RBS, with the nucleotide sequence set forth in any of SEQ ID NOs: 10-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 2-8; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 11-18. In some cases, a subject nucleic acid includes a promoter that includes a nucleotide sequence with the promoter sequence set forth in any of SEQ ID NOs: 2-8; and a nucleotide sequence, encoding an RBS, with the nucleotide sequence set forth in any of SEQ ID NOs: 11-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 2-8; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 12-18. In some cases, a subject nucleic acid includes a promoter that includes a nucleotide sequence with the promoter sequence set forth in any of SEQ ID NOs: 2-8; and a nucleotide sequence, encoding an RBS, with the nucleotide sequence set forth in any of SEQ ID NOs: 12-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-8; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 10-18. In some cases, a subject nucleic acid includes a promoter that includes a nucleotide sequence with the promoter sequence set forth in any of SEQ ID NOs: 1-8; and a nucleotide sequence, encoding an RBS, with the nucleotide sequence set forth in any of SEQ ID NOs: 10-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-8; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 11-18. In some cases, a subject nucleic acid includes a promoter that includes a nucleotide sequence with the promoter sequence set forth in any of SEQ ID NOs: 1-8; and a nucleotide sequence, encoding an RBS, with the nucleotide sequence set forth in any of SEQ ID NOs: 11-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-8; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 12-18. In some cases, a subject nucleic acid includes a promoter that includes a nucleotide sequence with the promoter sequence set forth in any of SEQ ID NOs: 1-8; and a nucleotide sequence, encoding an RBS, with the nucleotide sequence set forth in any of SEQ ID NOs: 12-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 381-388; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 10-18. In some cases, a subject nucleic acid includes a promoter that includes a nucleotide sequence with the promoter sequence set forth in any of SEQ ID NOs: 381-388; and a nucleotide sequence, encoding an RBS, with the nucleotide sequence set forth in any of SEQ ID NOs: 10-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 381-388; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 11-18. In some cases, a subject nucleic acid includes a promoter that includes a nucleotide sequence with the promoter sequence set forth in any of SEQ ID NOs: 381-388; and a nucleotide sequence, encoding an RBS, with the nucleotide sequence set forth in any of SEQ ID NOs: 11-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 381-388; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 12-18. In some cases, a subject nucleic acid includes a promoter that includes a nucleotide sequence with the promoter sequence set forth in any of SEQ ID NOs: 381-388; and a nucleotide sequence, encoding an RBS, with the nucleotide sequence set forth in any of SEQ ID NOs: 12-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 388 and 407 (or in some cases SEQ ID NOs: 388 and 406); and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 10-18. In some cases, a subject nucleic acid includes a promoter that includes a nucleotide sequence with the promoter sequence set forth in any of SEQ ID NOs: 388 and 407 (or in some cases SEQ ID NOs: 388 and 406); and a nucleotide sequence, encoding an RBS, with the nucleotide sequence set forth in any of SEQ ID NOs: 10-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 388 and 407 (or in some cases SEQ ID NOs: 388 and 406); and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 11-18. In some cases, a subject nucleic acid includes a promoter that includes a nucleotide sequence with the promoter sequence set forth in any of SEQ ID NOs: 388 and 407 (or in some cases SEQ ID NOs: 388 and 406); and a nucleotide sequence, encoding an RBS, with the nucleotide sequence set forth in any of SEQ ID NOs: 11-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 388 and 407 (or in some cases SEQ ID NOs: 388 and 406); and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 12-18. In some cases, a subject nucleic acid includes a promoter that includes a nucleotide sequence with the promoter sequence set forth in any of SEQ ID NOs: 388 and 407 (or in some cases SEQ ID NOs: 388 and 406); and a nucleotide sequence, encoding an RBS, with the nucleotide sequence set forth in any of SEQ ID NOs: 12-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-7; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 10-18. In some cases, a subject nucleic acid includes a promoter that includes a nucleotide sequence with the promoter sequence set forth in any of SEQ ID NOs: 1-7; and a nucleotide sequence, encoding an RBS, with the nucleotide sequence set forth in any of SEQ ID NOs: 10-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-7; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 11-18. In some cases, a subject nucleic acid includes a promoter that includes a nucleotide sequence with the promoter sequence set forth in any of SEQ ID NOs: 1-7; and a nucleotide sequence, encoding an RBS, with the nucleotide sequence set forth in any of SEQ ID NOs: 11-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-7; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 12-18. In some cases, a subject nucleic acid includes a promoter that includes a nucleotide sequence with the promoter sequence set forth in any of SEQ ID NOs: 1-7; and a nucleotide sequence, encoding an RBS, with the nucleotide sequence set forth in any of SEQ ID NOs: 12-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-7 and 381-387; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 10-18. In some cases, a subject nucleic acid includes a promoter that includes a nucleotide sequence with the promoter sequence set forth in any of SEQ ID NOs: 1-7 and 381-387; and a nucleotide sequence, encoding an RBS, with the nucleotide sequence set forth in any of SEQ ID NOs: 10-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-7 and 381-387; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 11-18. In some cases, a subject nucleic acid includes a promoter that includes a nucleotide sequence with the promoter sequence set forth in any of SEQ ID NOs: 1-7 and 381-387; and a nucleotide sequence, encoding an RBS, with the nucleotide sequence set forth in any of SEQ ID NOs: 11-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-7 and 381-387; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 12-18. In some cases, a subject nucleic acid includes a promoter that includes a nucleotide sequence with the promoter sequence set forth in any of SEQ ID NOs: 1-7 and 381-387; and a nucleotide sequence, encoding an RBS, with the nucleotide sequence set forth in any of SEQ ID NOs: 12-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 2-8, 151-364, and 382-388; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 10-18. In some cases, a subject nucleic acid includes a promoter that includes a nucleotide sequence with the promoter sequence set forth in any of SEQ ID NOs: 2-8, 151-364, and 382-388; and a nucleotide sequence, encoding an RBS, with the nucleotide sequence set forth in any of SEQ ID NOs: 10-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 2-8, 151-364, and 382-388; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 11-18. In some cases, a subject nucleic acid includes a promoter that includes a nucleotide sequence with the promoter sequence set forth in any of SEQ ID NOs: 2-8, 151-364, and 382-388; and a nucleotide sequence, encoding an RBS, with the nucleotide sequence set forth in any of SEQ ID NOs: 11-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 2-8, 151-364, and 382-388; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 12-18. In some cases, a subject nucleic acid includes a promoter that includes a nucleotide sequence with the promoter sequence set forth in any of SEQ ID NOs: 2-8, 151-364, and 382-388; and a nucleotide sequence, encoding an RBS, with the nucleotide sequence set forth in any of SEQ ID NOs: 12-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-7, 151-364, and 381-387; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 10-18. In some cases, a subject nucleic acid includes a promoter that includes a nucleotide sequence with the promoter sequence set forth in any of SEQ ID NOs: 1-7, 151-364, and 381-387; and a nucleotide sequence, encoding an RBS, with the nucleotide sequence set forth in any of SEQ ID NOs: 10-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-7, 151-364, and 381-387; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 11-18. In some cases, a subject nucleic acid includes a promoter that includes a nucleotide sequence with the promoter sequence set forth in any of SEQ ID NOs: 1-7, 151-364, and 381-387; and a nucleotide sequence, encoding an RBS, with the nucleotide sequence set forth in any of SEQ ID NOs: 11-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-7, 151-364, and 381-387; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 12-18. In some cases, a subject nucleic acid includes a promoter that includes a nucleotide sequence with the promoter sequence set forth in any of SEQ ID NOs: 1-7, 151-364, and 381-387; and a nucleotide sequence, encoding an RBS, with the nucleotide sequence set forth in any of SEQ ID NOs: 12-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-8, 151-364, and 381-388; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 10-18. In some cases, a subject nucleic acid includes a promoter that includes a nucleotide sequence with the promoter sequence set forth in any of SEQ ID NOs: 1-8, 151-364, and 381-388; and a nucleotide sequence, encoding an RBS, with the nucleotide sequence set forth in any of SEQ ID NOs: 10-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-8, 151-364, and 381-388; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 11-18. In some cases, a subject nucleic acid includes a promoter that includes a nucleotide sequence with the promoter sequence set forth in any of SEQ ID NOs: 1-8, 151-364, and 381-388; and a nucleotide sequence, encoding an RBS, with the nucleotide sequence set forth in any of SEQ ID NOs: 11-18.

In some cases, a subject nucleic acid includes a promoter that includes a nucleotide sequence having 75% or more identity (e.g., 80% or more, 85% or more, 90% or more, 95% or more, 98% or more, 99% or more, 99.5% or more, 99.8% or more, or 100% identity) with the promoter sequence set forth in any of SEQ ID NOs: 1-8, 151-364, and 381-388; and a nucleotide sequence, encoding an RBS, having 75% or more identity (e.g., 80% or more, 85% or more, 90% or more, 95% or more, 98% or more, 99% or more, 99.5% or more, 99.8% or more, or 100% identity) with the nucleotide sequence set forth in any of SEQ ID NOs: 12-18. In some cases, a subject nucleic acid includes a promoter that includes a nucleotide sequence with the promoter sequence set forth in any of SEQ ID NOs: 1-8, 151-364, and 381-388; and a nucleotide sequence, encoding an RBS, with the nucleotide sequence set forth in any of SEQ ID NOs: 12-18.

In some cases, a subject nucleic acid includes a nucleotide sequence having the sequence of the promoter/RBS combination set forth in any of SEQ ID NOs: 20-83. In some cases, a subject nucleic acid includes a nucleotide sequence having the sequence of the promoter/RBS combination set forth in any of SEQ ID NOs: 28-83.

Nucleotide Sequence of Interest

As noted above, provided are nucleic acids (e.g., expression vectors) that include a promoter sequence operably linked to a nucleotide sequence of interest. A nucleotide sequence of interest of a subject nucleic acid is operably linked to a promoter. The terms "operably linked" and "operable linkage" as used herein refer to a juxtaposition wherein the components so described are in a relationship permitting them to function in their intended manner. For instance, a promoter is operably linked to a nucleotide sequence if the promoter affects the transcription and/or expression of the nucleotide sequence. As another example, a ribosomal binding site (RBS) (e.g., a Shine Dalgarno sequence, a synthetic RBS, and the like) is a site in an mRNA that facilitates the translation of the mRNA into protein. Thus, a subject nucleotide sequence of interest (e.g. one encoding an mRNA, i.e., one encoding a protein) is operably linked to a sequence encoding an RBS if, once transcribed into RNA, the RBS affects the translation of the transcribed nucleotide sequence of interest. Therefore, a sequence encoding an RBS can be operably linked to both a promoter and a nucleotide sequence of interest if the nucleotide sequence of interest is also operably linked to the same promoter. In other words, a promoter can be operably linked to both a sequence encoding an RBS and to a nucleotide sequence of interest, the sequence encoding the RBS can be operably linked to both the promoter and the nucleotide sequence of interest, and the nucleotide sequence of interest can be operably linked to both the promoter and the sequence encoding the RBS.

As used herein, for the purposes of this disclosure, it is equivalent to say that a 'nucleotide sequence is operably linked to a promoter' and to say that the 'promoter is operably linked to the nucleotide sequence' (or to say that the two are in operable linkage with one another). Likewise, it is equivalent to say that a 'nucleotide sequence is operably linked to a sequence encoding an RBS' and to say that the 'sequence encoding an RBS is operably linked to the nucleotide sequence' (or to say that the two sequences are in operable linkage with one another).

A nucleotide sequence of interest can be any nucleotide sequence as long as the sequence is heterologous to the promoter to which it is operably linked. The term "heterologous," e.g., with respect to a heterologous nucleotide sequence, is a relative term referring to a nucleotide sequence (e.g., a nucleotide sequence of interest) that is related to another nucleotide sequence (e.g., a promoter) in a manner so that the two sequences are not arranged in the same relationship to each other as in nature. Heterologous nucleotide sequences include, e.g., a heterologous nucleotide sequence operably linked to a promoter, and a nucleic including a native promoter that is inserted into a heterologous vector (e.g., for introduction into a cell). Two heterologous nucleotide sequences (e.g., a nucleotide sequence operably linked to a promoter) can originate from different sources (e.g., one from a phage and one from a cell) or from the same source (e.g., both from a phage or both from a cell). Thus, when a subject nucleotide sequence of interest is heterologous to the promoter to which it is operably linked, the nucleotide sequence of interest is a sequence that is not found in nature in operable linkage with the promoter. In other words, the combination of promoter and nucleotide sequence of interest of a subject nucleic acid is a combination that is not naturally occurring.

Transgenes

Examples of nucleotide sequences of interest include but are not limited to transgene sequences and insertion sites. For example, in some cases, a nucleotide sequence of interest is a transgene (e.g., a transgene that encodes a protein, a transgene that encodes a non-coding RNA, a transgene that encodes a coding RNA, i.e., an mRNA). As used herein, the term "transgene" can be used to refer to a nucleotide sequence of interest that (i) is operably linked to a promoter (e.g., a promoter functional in prokaryotic cells, e.g., *Bacteroides* cells), (ii) encodes an expression product (e.g., protein, mRNA, non-coding RNA), and (iii) is capable of being expressed in a target cell (e.g., a prokaryotic cell such as a *Bacteroides* cell). Non-limiting examples of transgenes include nucleotide sequences that encode a peptide or polypeptide (i.e., protein coding sequences, mRNA sequences), and nucleotide sequences that encode non-translated RNAs (non-coding RNA, ncRNA) (e.g., a guide RNA for a genome editing protein such as a CRISPR/Cas protein like Cas9; an RNA such as antisense RNA, siRNA, shRNA, and miRNA; and the like). In some cases, a transgene is operably linked to a promoter functional in prokaryotic cells (e.g., *Bacteroides* cells).

In some cases, a transgene is a "marker" or "marker gene" or "marker protein." A marker is an expression product (e.g., mRNA, protein, non-coding RNA) that marks a host cell such that the host cell is detectable (e.g., detectably labeled). In some cases, the host cell is detectable by virtue of survival (e.g., the marker can be a "selectable marker"). In some cases, the host cell is detectable by observation (e.g., by direct visualization, by performing an assay, by performing a measurement step, and the like) and the marker can be referred to as a "reporter" or "reporter gene" or "reporter protein."

As noted above, some markers are "selectable markers." Selectable markers (a "selectable marker gene" can encode a "selectable marker protein") provide for selection, i.e., for selective retention of cells (e.g., prokaryotic cells) that comprise the selectable marker gene, during culturing and propagation of the cells. An example of a selectable marker is a transgene that encodes a drug selectable marker protein that provides drug resistance for prokaryotic cells (e.g., *Bacteroides* cells). Such a selectable marker encodes a drug selectable marker protein that provides resistance for prokaryotic cells to one or more drugs (e.g., kanamycin, neomycin, ampicillin, carbenicillin, chloramphenicol, gentamicin, tetracycline, rifampin, trimethoprim, hygromycin B, spectinomycin, and the like). Proteins that provide drug resistance to cells (e.g., prokaryotic cells) in which they are expressed are known in the art. For example, wild type genes/proteins are known that provide resistance (e.g., for prokaryotic cells) to the above drugs. For example, aminoglycoside 3'-phosphotransferase (APH), is a wild type protein that provides for resistance to the drugs Kanamycin, Neomycin and Geneticin (G418); while beta-lactamase is a wild type protein that provides for resistance to the drugs ampicillin and carbenecillin. Chloramphenicol acetyltransferase (cat) confers resistance to chloramphenicol. Genes conferring resistance to aminoglycosides include aac, aad, aph and strA/B. Genes conferring resistance to β-lactams include ampC, cmy, tem and vim. Genes conferring resistance to sulfonamides include suII and sulII. Genes conferring resistance to tetracycline include tet(A), tet(B), tet(C), tet(D) and regulator, and tetR. Selectable markers can also be those useful in balanced lethal systems, e.g., in which an essential gene is maintained on a plasmid with a corresponding chromosomal deletion or suppressible mutation on the host cell genome, e.g. a tRNA selectable marker that suppresses a host chromosomal gene mutation; those useful in repressor titration systems, in which an operator sequences, e.g. the lac operator or tet operator, placed on a plasmid, derepresses a chromosomal gene; antidote/poison selection schemes, in which an antidote to a poison expressed from the host chromosome (e.g. the ccdB gene) is maintained on the plasmid; and those useful in RNA-based selection schemes, e.g. antisense regulators, or antisense regulators that inhibit the translation of a gene transcribed from the host chromosome that would otherwise promote cell death.

Also as noted above, some markers are "reporters" or "reporter genes" or "reporter proteins." A "reporter" is a marker that provides an identifiable characteristic (trait) to a cell that expresses the reporter such that the cell can be identified relative to cells not expressing the reporter. A reporter is detectable by observation (e.g., by direct visualization, by performing an assay, by performing a measurement step, and the like). For example, a fluorescent protein such as GFP (green fluorescent protein) can be considered a reporter because those cells that express the gene encoding GFP can be readily identified relative to those cells not expressing GFP. Likewise, an enzyme such as luciferase can be considered a reporter because those cells that express the gene encoding luciferase can be readily identified relative to those cells not expressing luciferase (e.g., by performing an assay in which a substrate for luciferase is converted by luciferase into a detectable product).

In some cases, a transgene is an enzyme (e.g., a metabolic enzyme). For example, there are many small molecules produced by microbes in the gut that accumulate in the blood and cause or exacerbate diseases. Expressing an enzyme or a pathway (as a transgene) in a *Bacteroides* cell (or population of cells) to break down these products can be used in methods of treatment. For example, a *Bacteroides* cell expressing such a transgene can be introduced into the gut of an individual (e.g., in order to break down small molecules produced by microbes to reduce or even eliminate the amount absorbed by the gut of the individual, reducing the accumulation of the molecules in the blood of the individual). As an illustration that this is achievable (e.g., as proof of principle) see, e.g., FIG. 2e-2f and FIG. 3a of the working examples below, in which luciferase (an enzyme) was expressed and functional in *Bacteroides* that were introduced into the gut of an animal.

Secreted Fusion Proteins

In some embodiments, a transgene encodes a secreted protein (e.g., a therapeutic protein). For example, in some cases, a transgene is a secreted fusion protein that includes a polypeptide of interest and a secreted *Bacteroides* polypeptide (or secreted variant and/or fragment thereof). As used herein, the term "secreted" when referring to a protein product of a subject transgene, encompasses any route of being added into the extracellular environment. For example, in some cases, a subject polypeptide of interest is secreted by virtue of being fused to a secreted *Bacteroides* protein (e.g., BT0525)(e.g., see FIG. 23) that is secreted through the outer membrane. However, in some cases, a subject polypeptide of interest is secreted by virtue of being fused to a secreted *Bacteroides* protein (e.g., BT1488, SEQ ID NO: 484) that is released from outer membrane vesicles (see, e.g., Elhenawy et al, MBio. 2014 Mar. 11; 5(2); Hickey et al, Cell Host Microbe. 2015 May 13:17(5):672-80; and Shen et al, Cell Host Microbe. 2012 Oct. 18; 12(4):509-20). For example, in some cases, the outer-membrane buds off into small vesicles containing protein. Proteins secreted this way would be protected from degradation by gut proteases, and could also be delivered to the mammalian cell cytoplasm when those vesicles fuse to the cell membrane. Thus, in some cases the fusion protein is secreted through the outer membrane (e.g. when fused to BT0525), and in some cases the fusion protein is released from outer-membrane vesicles (e.g. when fused to BT1488), e.g., see FIG. 22.

The sequence of BT1488 is:

(SEQ ID NO: 484)
MAIAATILASCNKDEEETEIQGFKVLEYRPAPGQFINEGFDCQTMEEANA

YAEERFNKKLYVSLGSFGGYITVKMPKEIKNRKGYDFGIIGNPFSGSSEP

GIVWVSEDANGNGKADDVWYELKGSDEPERDYSVTYHRPDAAGDIPWED

```
-continued
NKGESGIIKYLPQYHDQMYYPNWIKEDSYTLKGSMLEARTEQEGGIWKNK

DFGKGYADNWGSDMAKDDNGNYRYNQFDLDDAVDQNGNPVTLERIHFV

KVQSAILKNVESIGEVSTEVVGFKAF
```

The term "secreted *Bacteroides* polypeptide" as used herein is meant to encompass any type of secretion, including those described in this paragraph.

As described in the examples section below, proteins were identified that are secreted by *Bacteroides* cells (e.g., see FIG. 17a-17e and FIG. 18a-18b). Provided herein are fusion proteins in which a polypeptide of interest is fused to a secreted *Bacteroides* protein or to a secreted variant (e.g., fragment) thereof. Examples of secreted *Bacteroides* proteins include but are not limited to those presented in FIG. 19 (SEQ ID NOs: 458-484). This list includes a set of proteins that were identified using proteomic data to be significantly over-represented in the supernatant (i.e. secreted) compared to what would be expected from a cell pellet (i.e. not-secreted) from *B. thetaiotaomicron* cultures. (e.g., see FIG. 17a). As such, a polypeptide of interest can be fused to any one of the proteins set forth in SEQ ID NOs: 458-484, or to a secreted variant (e.g., sequence variant, fragment, etc.) thereof. While the amino acid sequences set forth in SEQ ID NOs: 458-484 are full length protein sequences, one of ordinary skill in the art using routine and conventional techniques would be readily able to identify fragments and/or variants thereof that are also secreted. As would be recognized by one of ordinary skill in the art, because the purpose of fusing a polypeptide of interest (e.g., by fusing a nucleotide sequence encoding a polypeptide of interest to a nucleotide sequence encoding a secreted *Bacteroides* protein) to a secreted *Bacteroides* protein is to use the secreted *Bacteroides* protein as a carrier to deliver the polypeptide of interest into the extracellular space, the exact sequence and/or length of the secreted *Bacteroides* protein (or fragment thereof) is not crucial.

Thus, when using the terms "secreted *Bacteroides* protein" and "secreted *Bacteroides* polypeptide" herein, it is meant any protein (e.g., including any full length protein, variant, and/or fragment thereof) that is secreted by a *Bacteroides* cell into the extracellular space (e.g., via outer membrane vesicle release, via secretion across the outer membrane). As such, the terms encompass fusion proteins that include the entire full length sequence of a secreted *Bacteroides* protein (e.g., a naturally secreted *Bacteroides* protein), but also encompass fusion proteins that include secreted variants and/or secreted fragments of a secreted *Bacteroides* protein.

As noted above, in some cases, the secreted *Bacteroides* protein of a subject fusion protein includes the amino acid sequence set forth in any one of SEQ ID NOs: 458-484, or is a secreted variant and/or fragment thereof. In some cases, the secreted *Bacteroides* protein of a subject fusion protein is BT0525 (SEQ ID NO: 459) (or a secreted variant and/or secreted fragment thereof). Thus, in some cases, the secreted *Bacteroides* protein of a subject fusion protein is a secreted variant and/or a secreted fragment of BT0525 (SEQ ID NO: 459). In some cases the fusion protein is secreted through the outer membrane (e.g. when fused to BT0525). In some cases the fusion protein is released from outer-membrane vesicles (e.g. when fused to BT1488, SEQ ID NO: 484) (e.g., see FIG. 22).

In some cases, a secreted *Bacteroides* protein of a subject secreted fusion protein has an amino acid sequence having 80% or more (85% or more, 90% or more, 92% or more, 95% or more, 98% or more, 99% or more, 99.5% or more, or 100%) sequence identity with the amino acid sequence set forth in any of SEQ ID NOs: 458-484. In some cases, a secreted *Bacteroides* protein of a subject secreted fusion protein has an amino acid sequence having 80% or more (85% or more, 90% or more, 92% or more, 95% or more, 98% or more, 99% or more, 99.5% or more, or 100%) sequence identity with the amino acid sequence set forth in any of SEQ ID NOs: 458-484 over a stretch of 20 or more amino acids. In some cases, a secreted *Bacteroides* protein of a subject secreted fusion protein has an amino acid sequence having 80% or more (85% or more, 90% or more, 92% or more, 95% or more, 98% or more, 99% or more, 99.5% or more, or 100%) sequence identity with the amino acid sequence set forth in SEQ ID NOs: 459. In some cases, a secreted *Bacteroides* protein of a subject secreted fusion protein has an amino acid sequence having 80% or more (85% or more, 90% or more, 92% or more, 95% or more, 98% or more, 99% or more, 99.5% or more, or 100%) sequence identity with the amino acid sequence set forth in SEQ ID NOs: 459 over a stretch of 20 or more amino acids.

The polypeptide of interest of a subject secreted fusion protein can be any polypeptide. In some cases, the polypeptide of interest is a therapeutic peptide (e.g., a metabolic enzyme or a peptide that can, when secreted from a *Bacteroides* cell, e.g., in the gut of an individual, have a positive impact on a clinical parameter of the individual). For example, see below for methods of delivering and for methods of treating. Examples of therapeutic peptides include but are not limited to metabolic enzymes (e.g., as discussed elsewhere herein) and anti-inflammatory peptides, which can include but are not limited to those presented in Table 8 (SEQ ID NOs: 411-417). In some cases, the polypeptide of interest includes an amino acid sequence selected from: RYTVELA (SEQ ID NO: 411)(Peptide 101.10), VTLVGNTFLQSTINRTIGVL (SEQ ID NO: 412)(Fp MAM-pep5), and MQPPGC (SEQ ID NO: 413)(CD80-CAP1). In some cases, the polypeptide of interest includes an amino acid sequence selected from: RYTVELA (SEQ ID NO: 411)(Peptide 101.10), and VTLVGNTFLQSTINRTIGVL (SEQ ID NO: 412)(Fp MAM-pep5). In some cases, the polypeptide of interest includes the amino acid sequence RYTVELA (SEQ ID NO: 411)(Peptide 101.10). In some cases, the polypeptide of interest includes the amino acid sequence VTLVGNTFLQSTINRTIGVL (SEQ ID NO: 412) (Fp MAM-pep5).

TABLE 8

Examples of therapeutic peptides (polypeptides of interested) that can be fused to a secreted Bacteroides protein to form a subject secreted fusion protein.

| Peptide | AA sequence | SEQ ID NO | Type |
|---|---|---|---|
| 101.10 | RYTVELA | 411 | IL-1 inhibitory peptides |
| Fp MAM-pep5 | VTLVGNTFLQSTINRTIGVL | 412 | anti-NF-KB |
| CD80-CAP1 | MQPPGC | 413 | CD80 antagonistoc peptide |
| Pep2305 | TEEEQQLY | 414 | IL-23 inhibitory peptides |

TABLE 8-continued

Examples of therapeutic peptides (polypeptides of interested) that can be fused to a secreted Bacteroides protein to form a subject secreted fusion protein.

| Peptide | AA sequence | SEQ ID NO | Type |
|---|---|---|---|
| KPV | KPV | 415 | NF-kB and MAPK inhibition |
| WP9QY | YCWSQYLCY | 416 | anti-TNF |
| P144 | TSLDASIIWAMMQN | 417 | TGF-b inhibitory peptide |

In some embodiments, a subject secreted fusion protein includes more than one polypeptide of interest (e.g., two or more, three or more, or four or more polypeptides of interest). In some such cases, the polypeptides of interest can be separated by linkers (e.g., cleavable linkers).

A subject polypeptide of interest of a fusion protein can have any desirable length. For example, in the case of a secreted fusion protein, the polypeptide of interest can have any desirable length as long as the polypeptide of interest is secreted from the cell (e.g., secreted as part of the fusion protein and in some cases separated from the fusion after secretion via cleavage of a linker, secreted by the cell after cleavage of a cleavable linker, and the like). In some embodiments, a polypeptide of interest has a length of 2 amino acids or more (e.g., 3 amino acids or more, 5 amino acids or more, 6 amino acids or more, 7 amino acids or more, or 10 amino acids or more). In some cases, a polypeptide of interest has a length in a range of from 2 to 1000 amino acids (e.g., 2 to 500, 2 to 300, 2 to 200, 2 to 100, 2 to 75, 2 to 50, 2 to 30, 2 to 25, 2 to 20, 3 to 1000, 3 to 500, 3 to 300, 3 to 200, 3 to 100, 3 to 75, 3 to 50, 3 to 30, 3 to 25, 3 to 20, 5 to 1000, 5 to 500, 5 to 300, 5 to 200, 5 to 100, 5 to 75, 5 to 50, 5 to 30, 5 to 25, or 5 to 20 amino acids). In some cases, a polypeptide of interest has a length in a range of from 3 to 50 amino acids (e.g., 3 to 30, 3 to 25, 3 to 20, 5 to 50, 5 to 30, 5 to 25, or 5 to 20 amino acids). In some cases, a polypeptide of interest has a length in a range of from 6 to 40 amino acids (e.g., 6 to 30, 6 to 25, 6 to 20, 7 to 40, 7 to 30, 7 to 25, or 7 to 20 amino acids).

In some cases, the polypeptide of interest (e.g., therapeutic peptide) of a subject secreted fusion protein is fused to a secreted *Bacteroides* protein (or secreted variant and/or fragment thereof) via a linker (i.e., a linker is positioned between the secreted *Bacteroides* protein and the polypeptide of interest). Thus, in some cases, a subject fusion protein includes a linker and a secreted *Bacteroides* protein fused to a heterologous polypeptide of interest, where the linker is positioned between the secreted *Bacteroides* protein and the polypeptide of interest. In some cases, the linker is a cleavable linker. In some cases, a cleavable linker is a self-cleaving linker (e.g., a 2A peptide, an intein, etc.). In some such cases a cleavable linker is cleavable by one or more gut proteases. When a subject secreted fusion protein includes a polypeptide of interest (e.g., therapeutic peptide) fused to a secreted *Bacteroides* protein (or secreted variant and/or fragment thereof) via a linker that is cleavable by one or more gut proteases, the polypeptide of interest will be released from the secreted *Bacteroides* protein only after secretion and only when the extracellular environment (e.g., an animal gut) includes an appropriate corresponding protease.

In some cases, a cleavable linker is cleavable by one or more host cell proteases (e.g., proteases of a *Bacteroides* cell or proteases of a cell of the host animal's gut) (e.g., an extracellular protease such as a matrix metalloproteinase, or an endopeptidase-2; an intracellular protease such as a cysteine protease or a seine protease; and the like). As an illustrative example, a subject polypeptide of interest can be fused to a secreted *Bacteroides* protein such that the fusion protein is incorporated into outer membrane vesicles (OMVs) that are released from the *Bacteroides* cell and then fuse with a host animal's cell, thus delivering the polypeptide of interest into the cytoplasm of a host animal's cell. In this scenario, a cleavable linker can be cleavable by a eukaryotic cytoplasmic protease. When a subject secreted fusion protein includes a polypeptide of interest (e.g., therapeutic peptide) fused to a secreted *Bacteroides* protein (or secreted variant and/or fragment thereof) via a linker that is cleavable by one or more host cell proteases (e.g., an extracellular and/or intracellular host cell protease), the polypeptide of interest will be released from the secreted *Bacteroides* protein only after secretion and only when the environment (e.g., animal cell's cytoplasm) includes an appropriate corresponding protease.

Any convenient cleavable linker can be used and may 'target' gut proteases (and their corresponding cleavable linker sequences) will be known to one of ordinary skill in the art. Examples of gut proteases include but are not limited to those listed in Table 9. Thus, in some cases, a cleavable linker of a subject secreted fusion protein is cleavable by one or more gut proteases (also referred to herein as target peptidases) selected from: a trypsin, a chymotrypsin, and an elastase. In some cases, a cleavable linker of a subject secreted fusion protein is cleavable by one or more gut proteases selected from: chymotrypsin-like elastase family member 2A, anionic trypsin-2, chymotrypsin-C, chymotrypsinogen B, elastase 1, and elastase 3. In some cases, a cleavable linker of a subject secreted fusion protein is cleavable by one or more gut proteases selected from: trypsin, chymotrypsin (e.g., chymotrypsin B), and elastase (e.g., elastase 1, elastase 3). In some cases, a cleavable linker of a subject secreted fusion protein is cleavable by one or more gut proteases selected from trypsin, chymotrypsin, chymotrypsin B, and elastase (e.g., elastase 1, elastase 3).

TABLE 9

| Gut Enzymes and cleavage preferences | |
|---|---|
| Target gut proteases | Uniprot: Preferential cleavage |
| Chymotrypsin-like elastase family member 2A | Leu (L), Met (M) and Phe (F) |
| Anionic trypsin-2 | Arg (R), Lys (K). |
| Chymotrypsin-C | Leu (L), Tyr (Y), Phe (F), Met (M), Trp (W), Gln (Q), Asn (N). |
| Chymotrypsinogen B | Tyr (Y), Trp (W), Phe (F), Leu (L) |
| Elastase 1 | Ala (A) |
| Elastase 3 | Ala (A) |

A linker (e.g., cleavable linker) can have any convenient length. In some cases, a linker is 2 or more amino acids in length (e.g.,) In some embodiments, a linker (e.g., cleavable linker) has a length of 2 amino acids or more (e.g., 3 amino acids or more, 5 amino acids or more, 6 amino acids or more, 7 amino acids or more, or 10 amino acids or more). In some cases, a linker (e.g., cleavable linker) has a length in a range of from 2 to 50 amino acids (e.g., 2 to 30, 2 to 25, 2 to 20, 2 to 15, 2 to 10, 2 to 8, 3 to 50, 3 to 30, 3 to 25, 3 to 20, 3 to 15, 3 to 10, 3 to 8, 5 to 50, 5 to 30, 5 to 25, or 5 to 20, 5 to 15, 5 to 10, 5 to 8, 8 to 50, 8 to 30, 8 to 25, or 8 to 20, 8 to 15, or 8 to 10 amino acids). In some cases, a linker (e.g., cleavable linker) has a length in a range of from 4 to 20 amino acids (e.g., 5 to 20, 5 to 15, 5 to 10, 5 to 8, 8 to 20, 8 to 15, or 8 to 10 amino acids).

A cleavable linker can include one or more (e.g., 2 or more, 3 or more, 4 or more, or 5 or more) non-cleavable amino acids followed by a cleavable amino acid. In some cases, a cleavable linker includes in a range of from 2 to 50 non-cleavable amino acids (e.g., 2 to 25, 2 to 20, 2 to 15, 2 to 10, 2 to 8, 2 to 5, 5 to 50, 5 to 25, 5 to 20, 5 to 15, 5 to 10, or 5 to 8 non-cleavable amino acids) followed by a cleavable amino acid. In some cases, a cleavable linker includes in a range of from 2 to 10 non-cleavable amino acids (e.g., 2 to 8, 2 to 5, 5 to 10, or 5 to 8 non-cleavable amino acids) followed by a cleavable amino acid.

In some cases the one or more (e.g., 2 or more, 3 or more, 4 or more, or 5 or more) non-cleavable amino acids are selected from S, G, T, P, M, H, A, D, E, N, and V. In some cases the one or more (e.g., 2 or more, 3 or more, 4 or more, or 5 or more) non-cleavable amino acids are selected from S, G, T, P, M, H, and A. In some cases the one or more (e.g., 2 or more, 3 or more, 4 or more, or 5 or more) non-cleavable amino acids are selected from S, G, T, P, and A.

In some cases, the cleavable amino acid is selected from R, L, F, A, K, M, W, Q, Y, and L. In some cases, the cleavable amino acid is selected from R, L, F, and A.

In some cases, a cleavable linker includes one or more (e.g., 2 or more, 3 or more, 4 or more, or 5 or more) non-cleavable amino acids selected from S, G, T, P, M, H, A, D, E, N, and V followed by a cleavable amino acid selected from: R, L, F, A, K, M, W, Q, Y, and L. In some cases, a cleavable linker includes one or more (e.g., 2 or more, 3 or more, 4 or more, or 5 or more) non-cleavable amino acids selected from S, G, T, P, M, H, and A followed by a cleavable amino acid selected from: R, L, F, A, K, M, W, Q, Y, and L. In some cases, a cleavable linker includes one or more (e.g., 2 or more, 3 or more, 4 or more, or 5 or more) non-cleavable amino acids selected from S, G, T, P, and A followed by a cleavable amino acid selected from: R, L, F, A, K, M, W, Q, Y, and L. In some cases, a cleavable linker includes one or more (e.g., 2 or more, 3 or more, 4 or more, or 5 or more) non-cleavable amino acids selected from S, G, T, P, M, H, A, D, E, N, and V followed by a cleavable amino acid selected from: R, L, F, and A. In some cases, a cleavable linker includes one or more (e.g., 2 or more, 3 or more, 4 or more, or 5 or more) non-cleavable amino acids selected from S, G, T, P, M, H, and A followed by a cleavable amino acid selected from: R, L, F, and A. In some cases, a cleavable linker includes one or more (e.g., 2 or more, 3 or more, 4 or more, or 5 or more) non-cleavable amino acids selected from S, G, T, P, and A followed by a cleavable amino acid selected from: R, L, F, and A. In some cases, a cleavable linker includes one or more (e.g., 2 or more, 3 or more, 4 or more, or 5 or more) non-cleavable amino acids selected from S, G, T, P, and A followed by a P followed by a cleavable amino acid selected from: R, L, F, and A (e.g., followed by a P followed by an F).

Motifs for various gut proteases are known in the art. For example, a motif for Chymotrypsin is A; followed by A; followed by a P or a V; followed by an F, Y, L, or W. Examples of suitable cleavable linkers include, but are not limited to those presented in Table 11. Additional examples of suitable cleavable linkers include, but are not limited to, those presented in Table 11. Additional examples of suitable cleavable linkers include, but are not limited to, those that include one or more (e.g., 2 or more, 3 or more, 4 or more, or 5 or more) non-cleavable amino acids (e.g., selected from S, G, T, P, and A) followed by any one of the sequences set forth in SEQ ID NOs: 427-453. In some cases, a cleavable linker includes an amino acid sequence selected from the sequences set forth in SEQ ID NOs: 427-453. In some cases, a cleavable linker includes the amino acid sequence TAPF (SEQ ID NO: 433).

TABLE 10

Examples of cleavable linker sequences and their target peptidase

| Linkers | Amino acid sequence (cleavage at bold amino acid | Target peptidase | SEQ ID NO: |
|---|---|---|---|
| CL1 | SGPTGHGR | Trypsin | 422 |
| CL2 | SGPTGMAR | Trypsin | 423 |
| CL3 | SGPTASPL | Chymotrypsin | 424 |
| CL4 | SGPTTAPF | Chymotrypsin B | 425 |
| CL5 | SGPTAAPA | Elastase 1 | 426 |

TABLE 11

Examples of cleavable linker sequences.

| Linker | SEQ ID NO: |
|---|---|
| GHGR | 427 |
| GMAR | 428 |
| ASPL | 429 |
| VPY | 430 |
| TAPY | 431 |
| VPF | 432 |
| TAPF | 433 |
| STAFF | 434 |
| GTAPF | 435 |
| TTAPF | 436 |
| PTAPF | 437 |
| SSTAPF | 438 |
| GSTAPF | 439 |
| TSTAPF | 440 |
| PSTAPF | 441 |
| SGTAPF | 442 |
| TGTAPF | 443 |
| GGTAPF | 444 |
| PGTAPF | 445 |
| STTAPF | 446 |
| GTTAPF | 447 |
| TTTAPF | 448 |
| PTTAPF | 449 |

TABLE 11-continued

Examples of cleavable linker sequences.

| Linker | SEQ ID NO: |
|---|---|
| SPTAPF | 450 |
| GPTAPF | 451 |
| TPTAPF | 452 |
| PPTAPF | 453 |

Insertion Sites

In some cases, a nucleotide sequence of interest of a subject nucleic acid (e.g., a vector such as a plasmid) is an insertion site. In some cases as subject nucleic acid of interested includes an insertion site in addition to a second nucleotide sequence of interest, such as any of those described above (e.g., a transgene, a sequence encoding a fusion protein, etc.). An insertion site is a nucleotide sequence used for the insertion of a desired sequence. For example, an insertion site can be a sequence in the nucleic acid at which a transgene sequence will later be inserted. "Insertion sites" for use with various technologies are known to those of ordinary skill in the art and any convenient insertion site can be used. An insertion site can be for any method for manipulating nucleic acid sequences. For example, in some cases the insertion site is a multiple cloning site (MCS) (e.g., a site including one or more restriction enzyme recognition sequences), a site for ligation independent cloning, a site for recombination based cloning (e.g., recombination based on att sites), a nucleotide sequence recognized by a CRISPR/Cas (e.g. Cas9) based technology, and the like.

An insertion site can be any desirable length, and can depend on the type of insertion sites (e.g., can depend on whether (and how many) the site includes one or more restriction enzyme recognition sequences, whether the site includes a target site for a CRISPR/Cas protein, etc.). In some cases, an insertion site of a subject nucleic acid is 3 or more nucleotides (nt) in length (e.g., 5 or more, 8 or more, 10 or more, 15 or more, 17 or more, 18 or more, 19 or more, 20 or more or 25 or more, or 30 or more nt in length). In some cases, the length of an insertion site of a subject nucleic acid has a length in a range of from 2 to 50 nucleotides (nt) (e.g., from 2 to 40 nt, from 2 to 30 nt, from 2 to 25 nt, from 2 to 20 nt, from 5 to 50 nt, from 5 to 40 nt, from 5 to 30 nt, from 5 to 25 nt, from 5 to 20 nt, from 10 to 50 nt, from 10 to 40 nt, from 10 to 30 nt, from 10 to 25 nt, from 10 to 20 nt, from 17 to 50 nt, from 17 to 40 nt, from 17 to 30 nt, from 17 to 25 nt). In some cases, the length of an insertion site of a subject nucleic acid has a length in a range of from 5 to 40 nt.

In some cases, an insertion site is said to be operably linked to a promoter. In general, the intent of an insertion site is that this region of the nucleic acid will get modified (e.g., in some cases replaced) to include a nucleotide sequence encoding a transgene of interest (e.g., a transgene encoding a non-coding RNA, a transgene encoding a protein, etc.), such that the inserted transgene sequence will, once inserted, be operably linked to the promoter to which the insertion site was/is operably linked. Likewise, in some cases, an insertion site is said to be operably linked to a sequence encoding an RBS. In such cases, the intent is that an inserted transgene sequence will, once inserted, be operably linked to the RBS to which the insertion site was/is operably linked.

For example, in some cases a subject nucleic acid includes an insertion site operably linked to a promoter. In some such cases, the nucleic acid could later be modified by inserting a transgene sequence into the insertion site, and in some such cases (e.g., if the transgene sequence encodes a protein), the sequence to be inserted may include a sequence encoding an RBS upstream of a transgene sequence.

In some cases, a subject nucleic acid includes an insertion site operably linked to a promoter and operably linked to a sequence encoding an RBS. In some such cases, the nucleic acid could later be modified by inserting a transgene sequence (e.g., a transgene sequence encoding a protein) into the insertion site such that the inserted sequence will, once inserted, be operably linked to both the promoter and the sequence encoding an RBS to which the insertion site was/is operably linked.

Nucleic Acids

In some embodiments, a subject nucleic acid is a vector. By a "vector" it is meant a nucleic acid that is capable of transferring a polynucleotide sequence, e.g. a transgene, to a target cell. For the purposes of the present disclosure, "vector construct" and "expression vector" generally refer to any nucleic acid construct, for example, a linear nucleic acid, a circular nucleic acid, a phage, a virus, a viral genome (a viral construct), a cosmid, a plasmid, and the like, that is capable of transferring a nucleotide sequence of interest (e.g., a transgene) into target cells (e.g., prokaryotic cells such as *Bacteroides* cells). Thus, the term includes cloning and expression vehicles, and extrachromosomally maintained vectors as well as integrating vectors.

In some cases, a subject expression vector is a linear nucleic acid vector. In some cases, a subject expression vector is a circular nucleic acid. In some cases, a subject expression vector can be maintained extrachromosomally, or"episomally" in the target cell, i.e., as a linear or circular nucleic acid that does not integrate into the target cell genome. In some cases, a subject expression vector can integrate into the genome of the host, i.e., as a linear or circular nucleic acid that integrates into the host genome.

In some cases, a subject nucleic acid (e.g., an expression vector) includes an origin of replication. By an "origin of replication" or "replication origin" it is meant a particular sequence in a genome at which replication is initiated. Origins of replication are found in prokaryotes and eukaryotes, and are required for the propagation of plasmids episomally (i.e. extragenomically) in host cells. By a "plasmid" it is meant a circular expression vector that comprises an origin of replication and a selectable marker.

In some cases, a subject nucleic acid (e.g., a plasmid) includes an origin of replication (e.g., one that is functional in a *Bacteroides* cell). However, in some embodiments, a subject nucleic acid (e.g., plasmid) has an origin of replication that is not functional in *Bacteroides* cells, but is functional in cells that are not *Bacteroides* cells (e.g., other prokaryotes such as *E. coli*). Such nucleic acids (e.g., plasmids such as an NBU2 integration plasmid) can be maintained episomally (e.g., propagated, amplified, isolated from, stored in, etc.) in prokaryotic cells that are not *Bacteroides* cells (e.g., they can in some cases be maintained episomally in *E. coli*), but are not maintained episomally in *Bacteroides* cells. Thus, instead of being maintained episomally in *Bacteroides* cells, these nucleic acids can be used for the integration of sequences (e.g., from a plasmid) into the genome of a *Bacteroides* cell (e.g., see the examples section below). In some cases, a subject nucleic acid is integrated into the genome of a *Bacteroides* cell.

Methods

Nucleic acid expression using a subject nucleic acid (e.g., one that is integrated into a *Bacteroides* cell's genome, an expression vector, a plasmid, and the like) finds use in many applications, including research and therapeutic applications. Subject methods include but are not necessarily limited to methods of expressing a transgene in a prokaryotic cell (e.g., a *Bacteroides* cell), detectably labeling a *Bacteroides* cell in an animal's gut (e.g., distinguishably labeling two or more *Bacteroides* cells), delivering a protein to an individual's gut, and treating an individual (e.g., by delivering a protein-secreting *Bacteroides* cell to an individual's gut).

In some embodiments (e.g., in methods of detectably labeling, delivering, and/or treating) a *Bacteroides* cell (e.g., a cell comprising a subject nucleic acid) is introduced into an individual (e.g., into the individual's gut). The individual can be any mammalian species, e.g. rodent (e.g., mouse, rat), ungulate, cow, pig, sheep, camel, rabbit, horse, dog, cat, primate, non-human primate, human, etc. The individual may be a neonate, a juvenile, or an adult. In some cases, the introduction is by oral administration. Any convenient type of oral administration can be used. For example, oral administration can include delivery via eating (e.g., incorporated into food), drinking (e.g., incorporated into a solution such as drinking water), oral gavage (e.g., using a stomach tube), aerosol spray, tablets, capsules, pills, powders, and the like. In some embodiments, a *Bacteroides* cell (e.g., a cell comprising a subject nucleic acid) is introduced into an individual (e.g., into the individual's gut) by delivery into the individual's colon.

As described for compositions, cells of the subject methods can be any prokaryotic cell in which a subject promoter is operable (e.g., prokaryotic cell, *Bacteroides* cell, *E. coli* cell). In some cases, the cell is a *Bacteroides* cell. In some cases, the *Bacteroides* cell is a species selected from: *B. fragilis* (B), *B. distasonis* (Bd), *B. thetaiotaomicron* (Bt), *B. vulgatus* (Bv), *B. ovatus* (Bo), *B. eggerrthii* (Be), *B. merdae* (Bm), *B. stercoris* (Bs), *B. uniformis* (Bu), and *B. caccae* (Bc). In some cases, the *Bacteroides* cell is a species selected from: *B. fragilis* (B), *B. thetaiotaomicron* (Bt), *B. vulgatus* (Bv), *B. ovatus* (Bo), and *B. uniformis* (Bu). In some cases, the *Bacteroides* cell is a species selected from: *B. thetaiotaomicron* (Bt), *B. vulgatus* (Bv), *B. ovatus* (Bo), and *B. uniformis* (Bu).

In some cases, a subject method is a method of expressing a subject nucleic acid in a prokaryotic cell. Such methods include introducing a subject nucleic acid into a prokaryotic cell. Any convenient method can be used to introduce a nucleic acid into a prokaryotic cell, e.g., by electroporation (e.g., using electro-competent cells), by conjugation, by chemical methods (e.g., using chemically competent cells), and the like. The introduced nucleic acid may or may not be integrated (covalently linked) into the genome of the cell, and as described above this may depend on the presence or absence of an origin of replication that is functional in the cell. For example, in some cases, the introduced nucleic acid integrates into the genome of the cell (as a chromosomal integrant), e.g., a nucleic acid may integrated into the genome of a *Bacteroides* cell if the nucleic acid does not have an origin of replication that is functional in that *Bacteroides* cell. In some cases, the introduced nucleic acid is maintained on an episomal element (extra chromosomal element) such as a plasmid.

In some cases, a subject method is a method of detectably labeling a *Bacteroides* cell in an animal's gut. In such cases, the *Bacteroides* cell (or population of cells) that is introduced into the gut, includes a subject nucleic acid that include a transgene whose expression produce detectably labels the cell. The phrase "detectably label" as used herein refers to a any detectable expression product (RNA, protein) that is detectable. The expression product (the label) can itself be detectable (directly detectable label) (e.g., a fluorescent protein), or the label can be indirectly detectable, e.g., in the case of an enzymatic label, the enzyme (e.g., luciferase) may catalyze a chemical alteration of a substrate compound or composition and the product of the reaction is detectable.

In some cases, two or more *Bacteroides* cells (e.g., two distinct populations of *Bacteroides* cells) are labeled in such a way that the two or more cells (or two or cell populations) are distinguishable from one another. The two cells (or cell populations) can differ from one another in a variety of ways. For example, the cells can be of different species (e.g., when it is desired to assay competition or balance between two different species), the cells can be expressing different transgenes (e.g., different therapeutic peptides), and the like.

Distinguishably labeling two or more cells (or cell populations) from one another can be achieved in a number of different ways and any convenient way is suitable. For example, a first cell (or cell population) can be labeled with a first transgene (i.e., the first cell includes a subject nucleic acid having a first transgene—where an expression product of the first transgene is detectable), while a second cell (or cell population) can be labeled with a second transgene (i.e., the second cell includes a subject nucleic acid having a second transgene—where an expression product of the second transgene is detectable). The two cells can be distinguishably labeled if the first and second expression products are different. As an illustrative example, such would be the case if—Case 1—(1) the first cell included a subject nucleic acid in which a sequence encoding a green fluorescent protein (GFP) was operably linked to a subject promoter, and (2) the second cell included a subject nucleic acid in which a sequence encoding a red fluorescent protein (RFP) was operably linked to a subject promoter. In Case 1, the promoters in the first and second cells could be the same promoter because the expression products themselves are distinguishable and thus, the first and second cells would be distinguishable from one another because the labels are distinguishable from one another.

However, two cells could also be distinguishably labeled from one another even if they were producing the same transgene expression product (e.g., GFP). As an illustrative example, such would be the case if—Case 2—(1) the first cell included a subject nucleic acid in which a sequence encoding a green fluorescent protein (GFP) was operably linked to a subject promoter, and (2) the second cell included a subject nucleic acid in which a sequence encoding a green fluorescent protein (GFP) (the same transgene as the first cell) was operably linked to a different promoter of different strength. In Case 2, the promoters in the first and second cells can be different so that the amount of transgene expression product produced is different between the first and second cells. The cells would then be distinguishable from one another because one would be characteristically brighter than the other.

In some cases, a detectably labeled *Bacteroides* cell (or cell population) is introduced into an animal's gut. In some cases, two or more distinguishably labeled *Bacteroides* cells (e.g., cell populations) can be introduced into an animal's gut. If desired, the label(s) can then be detected at numerous time points (tracked), and/or various parameters can be assayed. For example, measuring the label(s) can provide information about survival of the labeled cells in the gut, the sub-location of cells within the gut, the number of cells present of particular tracked species within the gut, the relative number of tracked species, and the like.

In some cases, a subject method is a method of delivering a protein to an individual's gut (which in some cases can be considered a method of treating). In some such cases, a *Bacteroides* cell is introduced into the gut of an animal, where the cell includes a subject nucleic acid encoding a subject fusion protein (e.g., a secreted *Bacteroides* polypeptide fused to a heterologous polypeptide of interest, e.g., a therapeutic peptide such as an anti-inflammation peptide or a metabolic enzyme). Any convenient fusion protein of the subject fusion proteins described above can be used. The polypeptide of interest of such of fusion protein can be one that has any desirable activity in the gut (e.g., in the extracellular environment of the gut, in side of the *Bacteroides* cell, or inside of a cell of the animal, e.g., if a subject fusion protein is secreted from the bacteria via outer membrane vesicles (OMVs) and the contents of the OMVs make their way into a host cell). As noted above, in some cases, the polypeptide of interest is a therapeutic peptide (e.g., a peptide that can, when secreted from a *Bacteroides* cell, e.g., in the gut of an individual via OMVs or via classical secretion across the outer membrane, have a positive impact on a clinical parameter of the individual) and the method can be considered a method of treating an individual in need thereof. For example, the polypeptide of interest can: have antimicrobial (antibiotic) activity (e.g., against one or more gut microbes), function to change gut environmental parameters (e.g., pH control), affect inflammation, provide an enzymatic activity to the *Bacteroides* cell (internal to the cell), and the like. All of these types of polypeptides of interest can be considered therapeutic peptides.

Because a large variety of polypeptides of interest (any polypeptide of interest) can be delivered using a subject secreted fusion protein (e.g., one with a cleavable linker between the polypeptide of interest and the secreted *Bacteroides* protein), a large variety of individuals with a large variety of ailments can be targeted (i.e., a subject *Bacteroides* cell can be introduced into a variety of individuals with a variety of ailments). Diseases that can be treated with a therapeutic peptide include but are not limited to diseases that are impacted by the gut microbiota, including obesity, diabetes, heart disease, central nervous system diseases, rheumatoid arthritis, metabolic disorders, and cancer. For example, in some cases, the individual has gut inflammation, and in some such cases the individual has antiinflammatory diseases (e.g., Crohn's disease, ulcerative colitis, and the like), and in some cases gut inflammation can indirectly impact the disease, such as colorectal cancer or obesity.

As noted above, examples of therapeutic peptides that can be used as polypeptides on interest in a subject fusion protein include but are not limited to metabolic enzymes and anti-inflammatory peptides, which can include but are not limited to those presented in Table 8 (SEQ ID NOs: 411-417). In some cases (e.g., in some cases where the individual has gut inflammation, e.g., colitis), the polypeptide of interest includes an amino acid sequence selected from: RYTVELA (SEQ ID NO: 411)(Peptide 101.10), VTLVGNTFLQSTINRTIGVL (SEQ ID NO: 412)(Fp MAM-pep5), and MQPPGC (SEQ ID NO: 413)(CD80-CAP1). In some cases (e.g., in some cases where the individual has gut inflammation, e.g., colitis), the polypeptide of interest includes an amino acid sequence selected from: RYTVELA (SEQ ID NO: 411)(Peptide 101.10), and VTLVGNTFLQSTINRTIGVL (SEQ ID NO: 412)(Fp MAM-pep5). In some cases, the polypeptide of interest includes the amino acid sequence RYTVELA (SEQ ID NO: 411)(Peptide 101.10). In some cases, the polypeptide of interest includes the amino acid sequence VTLVGNTFLQSTINRTIGVL (SEQ ID NO: 412)(Fp MAM-pep5).

Kits

Also provided are kits, e.g., for practicing any of the above methods. The contents of the subject kits may vary greatly. A kit can include: (i) a first subject nucleic acid (e.g., a nucleic acid that includes a promoter operable in a *Bacteroides* cell operably linked to a heterologous nucleotide sequence of interest), and (ii) at least one of: a *Bacteroides* cell, and a second subject nucleic acid. In some cases, the promoters of the first and second nucleic acids are different. In some cases, the nucleotide sequence of interest of the first and second nucleic acids are different. In some cases, a kit includes two or more (3 or more, 4 or more, etc.) subject nucleic acids, each with a different promoter (e.g., each with promoters of a different strength). In some cases, the nucleic acid(s) of a subject kit is a plasmid. In some cases, the plasmid(s) can be propagated episomally in *E. coli*, but does not contain an origin of replication that is functional in *Bacteroides* cells. In some cases, a subject kit includes one or more species of *Bacteroides* cells selected from: *B. fragilis* (B), *B. distasonis* (Bd), *B. thetaiotaomicron* (Bt), *B. vulgatus* (Bv), *B. ovatus* (Bo), *B. eggerrthii* (Be), *B. merdae* (Bm), *B. stercoris* (Bs), *B. uniformis* (Bu), and *B. caccae* (Bc). In some cases, the cell(s) of the kit do not (yet) contain a subject nucleic acid. In some cases, the cell(s) of the kit includes a subject nucleic acid integrated into the genome of the cell.

In addition to the above components, the subject kits can further include instructions for practicing the subject methods. These instructions may be present in the subject kits in a variety of forms, one or more of which may be present in the kit. One form in which these instructions may be present is as printed information on a suitable medium or substrate, e.g., a piece or pieces of paper on which the information is printed, in the packaging of the kit, in a package insert, etc. Yet another means would be a computer readable medium, e.g., diskette, CD, flash drive, etc., on which the information has been recorded. Yet another means that may be present is a website address which may be used via the internet to access the information at a removed site. Any convenient means may be present in the kits.

Examples of Non-Limiting Aspects of the Disclosure

Aspects, including embodiments, of the present subject matter described above may be beneficial alone or in combination, with one or more other aspects or embodiments. Without limiting the foregoing description, certain non-limiting aspects of the disclosure: Set A numbered 1-73; and Set B numbered 1-77 are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

Set A

1. A nucleic acid for expression in a prokaryotic cell, the nucleic acid comprising:

(a) a promoter operable in a *Bacteroides* cell, wherein the promoter comprises a nucleotide sequence having:

(i) 80% or more identity with the nucleotide sequence: GTTAA (n)$_{3-7}$ GTTAA (n)$_{36-38}$ TA (n)$_2$ TTG (SEQ ID NO: 400), and/or (ii) 80% or more identity with the phage promoter sequence set forth in any of SEQ ID NOs: 388 and 407; and (b) a heterologous nucleotide sequence of interest that is operably linked to the promoter.

2. The nucleic acid according to 1, wherein the nucleotide sequence of interest is a transgene sequence that encodes a protein.

3. The nucleic acid according to 2, wherein the protein encoded by the transgene sequence is a reporter protein, a selectable marker protein, a metabolic enzyme, and/or a therapeutic protein.

4. The nucleic acid according to 2 or 3, wherein the protein encoded by the transgene sequence is a fusion protein comprising a cleavable linker and a secreted *Bacteroides* polypeptide fused to a heterologous polypeptide of interest, wherein the cleavable linker is positioned between the secreted *Bacteroides* polypeptide and the polypeptide of interest.

5. The nucleic acid according to 1, wherein the nucleotide sequence of interest is a transgene sequence that encodes a non-coding RNA.

6. The nucleic acid according to 1, wherein the nucleotide sequence of interest is an insertion site.

7. The nucleic acid according to 6, wherein the insertion site is a multiple cloning site.

8. The nucleic acid according to any of 1-7, wherein the promoter comprises a nucleotide sequence that has 80% or more sequence identity with the wild type *Bacteroides* phage promoter sequence set forth in SEQ ID NO: 388.

9. The nucleic acid according to any of 1-8, wherein the promoter comprises the nucleotide sequence set forth in any of SEQ ID NOs: 381-388.

10. The nucleic acid according to 8 or 9, wherein the promoter is a synthetic promoter.

11. The nucleic acid according to any of 1-7, wherein the promoter comprises the nucleotide sequence GTTAA (n)$_{3-7}$ GTTAA (n)$_{36-38}$ TA (n)$_2$ TTTG (SEQ ID NO: 400).

12. The nucleic acid according to any of 1-11, further comprising a sequence encoding a ribosomal binding site (RBS), wherein the sequence encoding the ribosomal binding site (RBS) is operably linked to the promoter and to the nucleotide sequence of interest, and is positioned 5' of the nucleotide sequence of interest.

13. The nucleic acid according to 12, wherein the sequence encoding the RBS comprises a nucleotide sequence that has 80% or more sequence identity with the sequence set forth in any of SEQ ID NOs: 10-18.

14. The nucleic acid according to 12, wherein the RBS is a synthetic RBS and the sequence encoding the synthetic RBS comprises a nucleotide sequence that has 80% or more sequence identity with the sequence set forth in any of SEQ ID NOs: 11-18.

15. The nucleic acid according to any of 12-14, comprising the nucleotide sequence set forth in any of SEQ ID NOs: 20-83.

16. The nucleic acid according to any of 1-15, further comprising a terminator sequence upstream of the promoter.

17. The nucleic acid according to any of 1-16, wherein the nucleic acid is a plasmid.

18. The nucleic acid according to 17, wherein the plasmid comprises an origin of replication that functions in prokaryotic cells other than *Bacteroides* cells, but does not function in *Bacteroides* cells.

19. A nucleic acid for expression in a prokaryotic cell, the nucleic acid comprising, in 5' to 3' order:

(a) a promoter operable in a prokaryotic cell;

(b) a sequence encoding a synthetic ribosomal binding site (RBS), wherein said sequence: (i) is operably linked to the promoter, and (ii) comprises a nucleotide sequence that has 80% or more sequence identity with the sequence set forth in any of SEQ ID NOs: 10-18; and (c) a nucleotide sequence of interest that is operably linked to the promoter and to the synthetic RBS.

20. The nucleic acid according to 19, wherein the sequence encoding the synthetic RBS comprises the nucleotide sequence set forth in any of SEQ ID NOs: 11-18.

21. The nucleic acid according to 19 or 20, wherein the nucleotide sequence of interest encodes a protein.

22. The nucleic acid according to 19 or 20, wherein the nucleotide sequence of interest is an insertion site.

23. A prokaryotic cell comprising the nucleic acid of any of 1-22.

24. The prokaryotic cell of 23, wherein the nucleic acid is not integrated into a chromosome of the prokaryotic cell.

25. The prokaryotic cell of 23, wherein the nucleic acid is integrated into a chromosome of the prokaryotic cell.

26. The prokaryotic cell of any of 23-25, wherein the cell is a *Bacteroides* cell.

27. The prokaryotic cell of any of 23-25, wherein the cell is a prokaryotic cell that is not a *Bacteroides* cell.

28. The prokaryotic cell of 27, wherein the cell is an *E. coli* cell.

29. A kit for expression in prokaryotic cells, the kit comprising:

(i) a first nucleic acid of any of 1-22; and (ii) at least one of: (a) a *Bacteroides* cell, and (b) a second nucleic acid of any of 1-22.

30. The kit of 29, comprising the first and second nucleic acids, each of which comprise (i) a promoter that comprises a nucleotide sequence that has 80% or more sequence identity with the wild type *Bacteroides* phage promoter sequence set forth in SEQ ID NO: 388, and (ii) a sequence encoding a synthetic ribosomal binding site (RBS) that comprises a nucleotide sequence that has 80% or more sequence identity with the sequence set forth in any of SEQ ID NOs: 11-18.

31. The kit of 30, wherein the first and second nucleic acids each comprise the nucleotide sequence set forth in any of SEQ ID NOs: 20-83.

32. The kit of any of 29-31, wherein the first and/or second nucleic acid is a plasmid.

33. The kit of any of 29-32, comprising a third nucleic acid of any of 1-22.

34. A method of expressing a nucleic acid in a prokaryotic cell, the method comprising: introducing the nucleic acid of any of 1-22 into a prokaryotic cell.

35. The method according to 34, wherein the prokaryotic cell is a *Bacteroides* cell.

36. The method according to 35, wherein the *Bacteroides* cell is a cell of a species selected from: *B. fragilis* (Bt), *B. distasonis* (Bd), *B. thetaiotaomicron* (Bt), *B. vulgatus* (Bv), *B. ovatus* (Bo), *B. eggerrthii* (Be), *B. merdae* (Bm), *B. stercoris* (Bs), *B. uniformis* (Bu), and *B. caccae* (Bc).

37. The method according to 34, wherein the prokaryotic cell is an *E. coli* cell.

38. The method according to any of 34-37, wherein the nucleotide sequence of interest is a transgene encoding a fusion protein comprising a cleavable linker and a secreted *Bacteroides* polypeptide fused to a heterologous polypeptide of interest, wherein the cleavable linker is positioned between the secreted *Bacteroides* polypeptide and the polypeptide of interest.

39. A method of detectably labeling a *Bacteroides* cell in an animal's gut, the method comprising:
  introducing, into the gut of the animal, a first detectably labeled *Bacteroides* cell comprising a first nucleic acid comprising:
    (a) a first promoter operable in *Bacteroides* cells, wherein the first promoter comprises a nucleotide sequence having:
      (i) 80% or more identity with the nucleotide sequence: GTTAA (n)$_{3-7}$ GTTAA (n)$_{36-38}$ TA (n)$_2$ TTTG (SEQ ID NO: 400), and/or
      (ii) 80% or more identity with the phage promoter sequence set forth in any of SEQ ID NOs: 388 and 407; and
    (b) a first transgene comprising a nucleotide sequence that encodes a first expression product that detectably labels the first detectably labeled *Bacteroides* cell, wherein the first transgene is: (i) heterologous relative to the first promoter and (ii) operably linked to the first promoter.

40. The method according to 39, wherein the method comprises introducing, into the gut of the animal, a second detectably labeled *Bacteroides* cell comprising a second nucleic acid comprising:
  (a) a second promoter operable in *Bacteroides* cells, wherein the second promoter comprises a nucleotide sequence having:
    (i) 80% or more identity with the nucleotide sequence: GTTAA (n)$_{3-7}$ GTTAA (n)$_{36-38}$ TA (n)$_2$ TTG (SEQ ID NO: 400), and/or
    (ii) 80% or more identity with the phage promoter sequence set forth in any of SEQ ID NOs: 388 and 407; and
  (b) a second transgene comprising a nucleotide sequence that encodes a second expression product that detectably labels the second detectably labeled *Bacteroides* cell, wherein the second transgene is: (i) heterologous relative to the second promoter and (ii) operably linked to the second promoter,
  wherein the first and second detectably labeled *Bacteroides* cells are distinguishable from one another.

41. The method according to 40, wherein the first and second expression products are distinguishable from one another.

42. The method according to 41, wherein the first and second promoters are the same.

43. The method according to 40, wherein the first and second expression products are indistinguishable from one another, but the first and second promoters are different from one another and produce different amounts of the first and second expression products.

44. The method according to any of 39-43, wherein the first expression product is a reporter protein.

45. The method according to 44, wherein the reporter protein is a fluorescent protein.

46. The method according to any of 39-45, wherein the first *Bacteroides* cell is the same species as the second *Bacteroides* cell.

47. The method according to any of 39-45, wherein the first *Bacteroides* cell is not the same species as the second *Bacteroides* cell.

48. A fusion protein comprising: a secreted *Bacteroides* polypeptide fused to a heterologous polypeptide of interest.

49. The fusion protein of 48, wherein the secreted *Bacteroides* polypeptide is a secreted fragment or secreted variant of a naturally occurring *Bacteroides* polypeptide.

50. The fusion protein of 48 or 49, wherein the secreted *Bacteroides* polypeptide comprises an amino acid sequence that has 80% or more sequence identity with the amino acid sequence set forth in any of SEQ ID NOs: 458-484.

51. The fusion protein of 48, wherein the secreted *Bacteroides* polypeptide is a naturally occurring secreted protein of a *Bacteroides* cell.

52. The fusion protein of 48 or 51, wherein the secreted *Bacteroides* polypeptide comprises the amino acid sequence set forth in any of SEQ ID NOs: 458-484.

53. The fusion protein of 52, wherein the secreted *Bacteroides* polypeptide comprises the amino acid sequence set forth in SEQ ID NO: 459.

54. The fusion protein of any of 48-53, comprising a cleavable linker positioned between the secreted *Bacteroides* polypeptide and the polypeptide of interest.

55. The fusion protein of 54, wherein the cleavable linker is cleavable by one or more gut proteases.

56. The fusion protein of 55, wherein the cleavable linker is cleavable by one or more gut proteases selected from: a trypsin, a chymotrypsin, and an elastase.

57. The fusion protein of 55, wherein the cleavable linker is set forth in any of SEQ ID NOs: 420-453

58. The fusion protein of any of 48-57, wherein polypeptide of interest comprises the amino acid sequence of any one of the peptides presented in Table 8 (SEQ ID NOs: 411-417).

59. The fusion protein of 58, wherein polypeptide of interest comprises the amino acid sequence RYTVELA (SEQ ID NO: 411) or VTLVGNTFLQSTINRTIGVL (SEQ ID NO: 412).

60. A nucleic acid encoding the fusion protein of any of 48-59.

61. The nucleic acid of 60, wherein the nucleic acid is a plasmid.

62. The nucleic acid of 61, wherein the plasmid comprises an origin of replication that functions in prokaryotic cells other than *Bacteroides* cells, but does not function in *Bacteroides* cells.

63. A method of delivering a protein to an individual's gut, the method comprising: introducing, into an individual's gut, a *Bacteroides* cell comprising the nucleic acid according to any one of 1-22 and 60-62.

64. The method according to 63, wherein the nucleic acid is integrated into the genome of the *Bacteroides* cell.

65. The method according to 63 or 64, wherein the individual has a disease impacted by gut microbiota.

66. The method according to 65, wherein the individual has a disease selected from: obesity, diabetes, heart disease, central nervous system diseases, rheumatoid arthritis, metabolic disorders, and cancer.

67. The method according to 63 or 64, wherein the individual has gut inflammation.

68. The method according to 63 or 64, wherein the individual has colitis.

69. The method according to any of 65-68, wherein the method of is a method of treating the individual.

70. The method according to any of 63-69, wherein the *Bacteroides* cell is a cell of a species selected from: *B. fragilis* (B), *B. distasonis* (Bd). *B. thetaiotaomicron* (Bt), *B. vulgatus* (Bv), *B. ovatus* (Bo), *B. eggerrthii* (Be), *B. merdae* (Bm), *B. stercoris* (Bs), *B. uniformis* (Bu), and *B. caccae* (Bc).

71. The method of 70, wherein the *Bacteroides* cell is a *B. thetaiotaomicron* (Bt) cell.

72. The method according to any of 63-71, wherein polypeptide of interest comprises the amino acid sequence RYTVELA (SEQ ID NO: 411) or VTLVGNTFLQSTINRTIGVL (SEQ ID NO: 412).

73. A method of treating an individual in need thereof, comprising:
performing the method of any of 65-68.

Set B

1. A nucleic acid, comprising:
(a) a promoter operable in a prokaryotic cell, wherein the promoter comprises a nucleotide sequence comprising one or more of the following:
(i) 80% or more sequence identity of defined nucleotides of the nucleotide sequence:
GTTAA (n)$_{4-7}$ GTTAA (n)$_{34-38}$ TA (n)$_2$ TTTG,
(ii) 80% or more sequence identity with a sequence set forth in any of SEQ ID NOs: 388 and 407,
(iii) a nucleotide sequence comprising GTTAA (n)$_{4-7}$ GTTAA,
(iv) a nucleotide sequence comprising GTTAA (n)$_{44-50}$ TA,
(v) a nucleotide sequence comprising GTTAA (n)$_{48-54}$ TTTG,
(vi) a nucleotide sequence comprising GTTAA (n)$_{36-38}$ TA,
(vii) a nucleotide sequence comprising GTTAA (n)$_{40-42}$ TTTG,
(viii) a nucleotide sequence comprising GTTAA (n)$_{3-7}$ GTTAA (n)$_{36-38}$ TA,
(ix) a nucleotide sequence comprising GTTAA (n)$_{3-7}$ GTTAA (n)$_{40-42}$ TTTG,
(x) a nucleotide sequence comprising GTTAA (n)$_{44-50}$ TA (n)$_2$ TTTG,
(xi) a nucleotide sequence comprising GTTAA (n)$_{36-38}$ TA (n)$_2$ TTTG,
(xii) a nucleotide sequence comprising GTTAA (n)$_{0-20}$ GTTAA (n)$_{10-60}$ TA (n)$_{0-10}$ TTTG,
(xiii) a nucleotide sequence comprising TTAA (n)$_{0-10}$ TTAA (n)$_{30-50}$ TA (n)$_2$ TTTG,
(xiv) a nucleotide sequence comprising GTTAA (n)$_{4-7}$ GTTAA (n)$_{38-39}$ TA (n)$_2$ TTTGC,
(xv) a nucleotide sequence comprising GTTAA (n)$_{4-7}$ GTTAA (n)$_{36-38}$ TA (n)$_2$ TTTG,
(xvi) a nucleotide sequence comprising GTTAA (n)$_{4-7}$ GTTAA (n)$_{34-38}$ TA (n)$_2$ TTTG,
(xvii) a nucleotide sequence comprising GTTAA (n)$_{4-7}$ GTTAA (n)$_{36-38}$ TA (n)$_2$ TTTG,
(xviii) a nucleotide sequence comprising GTTAA (n)$_{3-7}$ GTTAA (n)$_{33-38}$ TA (n)$_2$ TTTG,
(xix) a nucleotide sequence comprising GTTAA (n)$_{4-7}$ GTTAA (n)$_{12-16}$ TTG (n)$_{18-22}$ TA (n)$_2$ TTTGC,
(xx) a nucleotide sequence comprising GTTAA (n)$_{3-7}$ GTTAA (n)$_{12-16}$ TTG (n)$_{18-22}$ TA (n)$_2$ TTTG,
(xxi) a nucleotide sequence comprising GTTAA (n)$_{4-8}$ GTTAA (n)$_{12-16}$ TTG (n)$_{18-22}$ TA (n)$_2$ TTTG, and
(xxii) a nucleotide sequence comprising GTTAA (n)$_{4-7}$ GTTAA (n)$_{12-16}$ TTG (n)$_{18-22}$ TA (n)$_2$ TTTG,
wherein each n is independently selected from A, C, G, and T; and
(b) a nucleotide sequence of interest that is operably linked to the promoter, wherein the nucleotide sequence of interest and the promoter are not found operably linked in nature.

2. The nucleic acid of 1, wherein the prokaryotic cell is a *Bacteroides* cell.

3. A nucleic acid, comprising:
(a) a promoter operable in a *Bacteroides* cell, and
(b) a nucleotide sequence of interest that is operably linked to the promoter, wherein the nucleotide sequence of interest and the promoter are not found operably linked in nature, wherein the promoter provides one or more of the following when the nucleic acid is expressed in the *Bacteroides* cell:
(i) an increase in mRNA production of at least 30% relative to a native *Bacteroides* promoter,
(ii) an increase in fluorescence of at least 2000% relative to autofluorescence, wherein the nucleotide sequence of interest encodes super-folding GFP, or
(iii) a cytoplasmic protein concentration of at least 1.5 μM, wherein the nucleotide sequence of interest encodes the protein.

4. The nucleic acid of 3, wherein the native *Bacteroides* promoter is a native *Bacteroides* rRNA promoter.

5. The nucleic acid of 3, wherein the increase in mRNA production is at least 50%.

6. The nucleic acid of 3, wherein the increase in mRNA production is at least 100%.

7. The nucleic acid of 3, wherein the increase in fluorescence is at least 5000%.

8. The nucleic acid of 3, wherein the increase in fluorescence is at least 8000%.

9. The nucleic acid of 3, wherein the cytoplasmic protein concentration is at least 2 μM.

10. The nucleic acid of 3, wherein the cytoplasmic protein concentration is at least 5 μM.

11. The nucleic acid of 3, wherein the cytoplasmic protein concentration is at least 10 μM.

12. The nucleic acid of 3, wherein the protein is luciferase.

13. The nucleic acid of 1 or 3, wherein the promoter is a phage promoter or a functional fragment thereof.

14. The nucleic acid of 12, wherein the phage is φB124-14.

15. The nucleic acid of 1 or 3, wherein the promoter is a non-naturally occurring promoter.

16. The nucleic acid of 1 or 3, wherein the promoter comprises a nucleotide sequence having 80% or more sequence identity with the nucleotide sequence: GTTAA (n)$_{3-7}$ GTTAA (n)$_{36-38}$ TA (n)$_2$ TTTG (SEQ ID NO: 400).

17. The nucleic acid of any of 1-7, wherein the promoter comprises the nucleotide sequence GTTAA (n)$_{3-7}$ GTTAA (n)$_{36-38}$ TA (n)$_2$ TTTG (SEQ ID NO: 400).

18. The nucleic acid of 1 or 3, wherein the promoter comprises a nucleotide sequence that has 80% or more sequence identity with the sequence set forth in any of SEQ ID NOs: 388 and 407.

19. The nucleic acid of 1 or 3, wherein the promoter comprises the nucleotide sequence set forth in any of SEQ ID NOs: 381-388.

20. The nucleic acid of 1 or 3, wherein the nucleotide sequence of interest comprises a transgene sequence that encodes a protein.

21. The nucleic acid of 17, wherein the protein encoded by the transgene sequence comprises a reporter protein, a selectable marker protein, a metabolic enzyme, or a therapeutic protein.

22. The nucleic acid of 17, wherein the protein encoded by the transgene sequence is a fusion protein comprising a cleavable linker and a secreted *Bacteroides* polypeptide fused to a heterologous polypeptide of interest, wherein the cleavable linker is positioned between the secreted *Bacteroides* polypeptide and the polypeptide of interest.

23. The nucleic acid of 1 or 3, wherein the nucleotide sequence of interest comprises a transgene sequence that encodes a non-coding RNA.

24. The nucleic acid of 1 or 3, wherein the nucleotide sequence of interest is an insertion site.

25. The nucleic acid of 24, wherein the insertion site is a multiple cloning site.

26. The nucleic acid of any of 1-25, further comprising a sequence encoding a ribosomal binding site (RBS), wherein the sequence encoding the ribosomal binding site (RBS) is operably linked to the promoter and to the nucleotide sequence of interest, and is positioned 5' of the nucleotide sequence of interest.

27. The nucleic acid of any of 1-26, further comprising a terminator sequence upstream of the promoter.

28. The nucleic acid of any of 1-27, wherein the nucleic acid is a plasmid.

29. The nucleic acid of 28, wherein the plasmid comprises an origin of replication that functions in prokaryotic cells other than *Bacteroides* cells, but does not function in *Bacteroides* cells.

30. A prokaryotic cell comprising the nucleic acid of any of 1-29.

31. The prokaryotic cell of 21, wherein the nucleic acid is not integrated into a chromosome of the prokaryotic cell.

32. The prokaryotic cell of 21, wherein the nucleic acid is integrated into a chromosome of the prokaryotic cell.

33. The prokaryotic cell of any of 21-22, wherein the prokaryotic cell is a *Bacteroides* cell.

34. The prokaryotic cell of any of 21-22, wherein the prokaryotic cell is not a *Bacteroides* cell.

35. The prokaryotic cell of 24, wherein the prokaryotic cell is an *E. coli* cell.

36. A method of expressing a nucleic acid in a prokaryotic cell, the method comprising: introducing the nucleic acid of any of 1-29 into the prokaryotic cell.

37. The method of 36, wherein the prokaryotic cell is a *Bacteroides* cell.

38. The method of 27, wherein the *Bacteroides* cell is a cell of a species selected from: *B. fragilis* (B), *B. distasonis* (Bd), *B. thetaiotaomicron* (Bt), *B. vulgatus* (Bv), *B. ovatus* (Bo), *B. eggerrthii* (Be), *B. merdae* (Bm), *B. stercoris* (Bs), *B. uniformis* (Bu), and *B. caccae* (Bc).

39. The method of 36, wherein the prokaryotic cell is an *E. coli* cell.

40. The method of any of 36-29, wherein the nucleotide sequence of interest is a transgene encoding a fusion protein comprising a cleavable linker and a secreted *Bacteroides* polypeptide fused to a heterologous polypeptide of interest, wherein the cleavable linker is positioned between the secreted *Bacteroides* polypeptide and the polypeptide of interest.

41. A fusion protein comprising: a secreted *Bacteroides* polypeptide fused to a heterologous polypeptide of interest.

42. The fusion protein of 31, wherein the secreted *Bacteroides* polypeptide is a secreted fragment or secreted variant of a naturally occurring *Bacteroides* polypeptide.

43. The fusion protein of 31-42, wherein the secreted *Bacteroides* polypeptide comprises an amino acid sequence that has 80% or more sequence identity with an amino acid sequence set forth in any of SEQ ID NOs: 458-484.

44. The fusion protein of 31, wherein the secreted *Bacteroides* polypeptide is a naturally occurring secreted protein of a *Bacteroides* cell.

45. The fusion protein of 31 or 44, wherein the secreted *Bacteroides* polypeptide comprises an amino acid sequence set forth in any of SEQ ID NOs: 458-484.

46. The fusion protein of 45, wherein the secreted *Bacteroides* polypeptide comprises the amino acid sequence set forth in SEQ ID NO: 459.

47. The fusion protein of any of 31-46, comprising a cleavable linker positioned between the secreted *Bacteroides* polypeptide and the polypeptide of interest.

48. The fusion protein of 33, wherein the cleavable linker is cleavable by one or more gut proteases.

49. The fusion protein of 34, wherein the cleavable linker is cleavable by one or more gut proteases selected from: a trypsin, a chymotrypsin, and an elastase.

50. The fusion protein of 34, wherein the cleavable linker is set forth in any of SEQ ID NOs: 420-453.

51. The fusion protein of any of 31-36, wherein the polypeptide of interest is an anti-inflammatory peptide.

52. The fusion protein of 37, wherein the anti-inflammatory peptide comprises an amino acid sequence set forth in any of SEQ ID NOs: 411-417.

53. The fusion protein of 38, wherein the anti-inflammatory peptide comprises the amino acid sequence RYTVELA (SEQ ID NO: 411) or VTLVGNTFLQSTINRTIGVL (SEQ ID NO: 412).

54. A nucleic acid encoding the fusion protein of any of 31-53.

55. The nucleic acid of 39, wherein the nucleic acid is a plasmid.

56. The nucleic acid of 40, wherein the plasmid comprises an origin of replication that functions in prokaryotic cells other than *Bacteroides* cells, but does not function in *Bacteroides* cells.

57. An outer membrane vesicle, comprising the fusion protein of any of 31-53.

58. A method of delivering a polypeptide, comprising: recombinantly expressing the fusion protein of any of 31-53 in a prokaryotic cell; and delivering the fusion protein or the polypeptide of interest outside of the prokaryotic cell.

59. The method of 43, wherein the secreted *Bacteroides* polypeptide is secreted from the cell.

60. The method of 43, further comprising releasing the polypeptide of interest from the secreted *Bacteroides* polypeptide.

61. The method of 60, wherein release is performed by a protease.

62. The method of 61, wherein the protease is a gut protease.

63. The method of 61, wherein the protease is a cytoplasmic protease.

64. The method of 61, wherein the protease is a protease found in a cell of a different organism than the prokaryotic cell.

65. The method of 43, further comprising delivering the fusion protein or the polypeptide of interest to a gut.

66. The method of 43, further comprising packaging the fusion protein or the polypeptide of interest into an outer membrane vesicle.

67. The method of 45, further comprising fusing the outer membrane vesicle with a cell membrane of a second cell.

68. The method of 43, further comprising delivering the fusion protein or the polypeptide of interest to a second cell.

69. The method of 47, wherein the second cell is a eukaryotic cell.

70. The method of 47, wherein the second cell is a mammalian cell.

71. A method of delivering a protein to an individual's gut, the method comprising: introducing, into an individual's gut, a *Bacteroides* cell comprising the nucleic acid of any one of 1-29 and 39-41.

72. The method of 50, wherein the nucleic acid is integrated into the genome of the *Bacteroides* cell.

73. The method of 50 or 72, wherein the individual has a disease impacted by gut microbiota.

74. The method of 50 or 72, wherein the individual has a disease selected from: obesity, diabetes, heart disease, central nervous system diseases, rheumatoid arthritis, metabolic disorders, and cancer.

75. The method of 50 or 72, wherein the individual has gut inflammation.

76. The method of 50 or 72, wherein the individual has colitis.

77. The method of any of 50-54, wherein the *Bacteroides* cell is a cell of a species selected from: *B. fragilis* (B), *B. distasonis* (Bd), *B. thetaiotaomicron* (Bt), *B. vulgatus* (Bv), *B. ovatus* (Bo), *B. eggerrthii* (Be), *B. merdae* (Bm), *B. stercoris* (Bs), *B. uniformis* (Bu), and *B. caccae* (Bc).

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Centigrade, and pressure is at or near atmospheric.

In the examples below, the platform for engineering *Bacteroides* presented herein adds to an emerging palette of tools that can synergize to add new dimensions to the mechanistic understanding of gut ecology. The work here provides an example of the basic molecular insight into *Bacteroides* promoter architecture, which required high throughput strain generation. In addition, the work here facilitates defining single cell behavior in the context of the complex and dynamic gut microbial ecosystem. For example, closely related species or isogenic knockout variants can be distinguished and provide a step toward single cell reporting of location specific conditions within the gut (e.g., mammalian gut). The work here also provides tools that can directly be applied to develop therapeutic microbes. High expression from a strain, with secretion and clean release of peptides was applied to developing two therapeutic strains, each successful in treating murine colitis. The compositions and methods provided here for strain manipulation, protein expression and peptide secretion were demonstrated to function predictably across the *Bacteroides* genus and in different genetic and environmental contexts.

Example 1: Strong Predictable Expression and High-Throughput Modification for the Abundant Gut Commensal Genus, *Bacteroides*

Appling synthetic biology to engineer gut-resident microbes provides a new avenue to investigate microbe-host interactions, perform diagnostics, and deliver therapeutics. The data presented here demonstrate a platform for engineering *Bacteroides*, the most abundant genus in Western microbiotas. Using a new high-throughput genomic integration method, a phage promoter was identified and a set of constitutive promoters spanning over four logs of strength was generated. These promoters produce an unprecedented level of expression, confer no fitness burden within the gut over 14 days, function predictably over a million-fold expression range in phylogenetically diverse *Bacteroides* species, and allowed strains living within the gut to be distinguished from one another by fluorescence.

Results

High-Throughput Strain Modification Method

Figure 4:
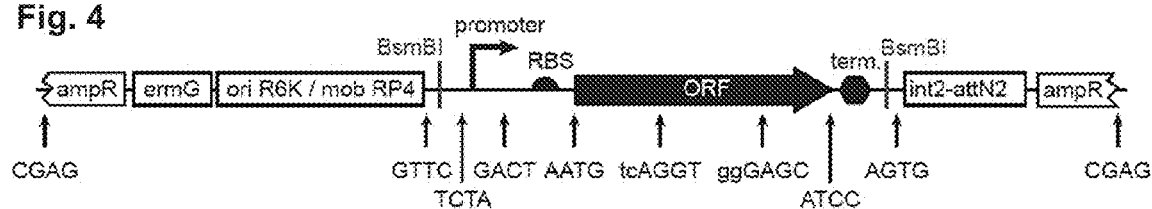
FIG. 4. Golden Gate assembly schematic for pNBU2 based plasmids. The junctions used in BsaI assembly of expression cassettes are capitalized. The split ampicillin resistance gene only functions when reassembled, thus eliminating carry through of undigested parts. BsmBI can be subsequently used for assembling multi-cassettes integration plasmids.

The NBU2 integration plasmid was adapted for compatibility with Golden Gate cloning to enable rapid and reliable plasmid construction and genomic integration. These modifications were used for basic DNA parts to be assembled into expression cassettes on *Bacteroides* integration plasmids in a one-pot reaction (FIG. 4). A conjugation protocol was also developed that can be executed with 96-well compatible liquid handling steps to improve through-put of genetic modification. When combined with Golden Gate cloning the entire process of going from basic parts to colonies of *Bacteroides* with genomically integrated constructs could be performed in 3 days with high-throughput liquid handling (FIG. 1). To assess the accuracy of this protocol, 40 different 4-piece assemblies were performed and these constructs were genomically integrated into 4 different species of *Bacteroides*: *B. thetaiotaomicron* (Bt), *B. vulgatus* (Bv), *B. ovatus* (Bo), and *B. uniformis* (Bu). A success rate of over 99% was achieved using this new pipeline, with similar success rates for each species (FIG. 15—Table 1).

Maximizing Protein Expression

Figure 5A:
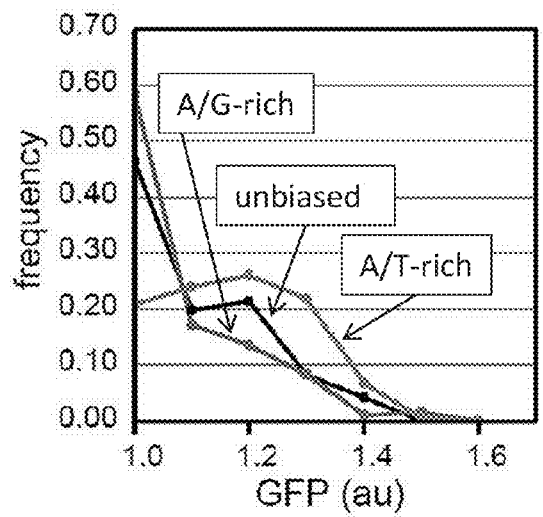
FIG. 5a-5b. Comparison of three GFP expression distributions across strains generated using different RBS libraries.
Figure 5B:
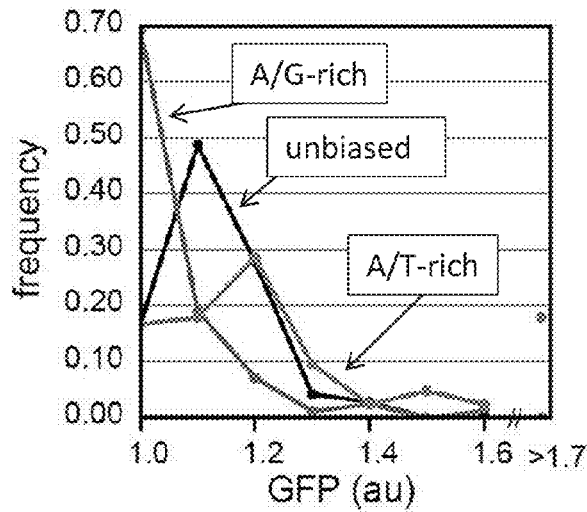

Expression of heterologous proteins in *Bacteroides* at levels sufficient for detection in vivo has been a substantial challenge. Initial attempts to produce high protein expression in Bt using the 16 S rRNA promoter ($P_{rRNA}$), previously used for high expression, combined with the *Bacteroides* consensus ribosome binding site (RBS) driving GFP failed to produce fluorescence above background levels. Thus, in an attempt to identify a strong RBS sequence and maximize protein production via translation, three different RBS libraries were designed: an A/G rich degenerate sequence resembling the reported consensus sequence, a completely degenerate sequence, and an A/T-rich sequence resembling the residues found upstream of *B. fragilis* (B) phage genes. When tested with $P_{rRNA}$ (FIG. 5a) and a fructose inducible promoter, $P_{BT1783}$ (FIG. 5b), the A/T-rich library sequence, $N_9W_3A_3W_2TWANAATAATG$ (SEQ ID NO: 371), produced substantially stronger expression sequences than the other two libraries, while the A/G-rich library produced even weaker expression than the unbiased degenerate sequence. The phage based RBS library sequence was similar to the A/T-rich RBSs of highly expressed native *Bacteroides* genes. Despite the improvements in translation, the highest expression strain produced fluorescence only 40% above background, prompting a search for stronger promoters.

Figure 2A:
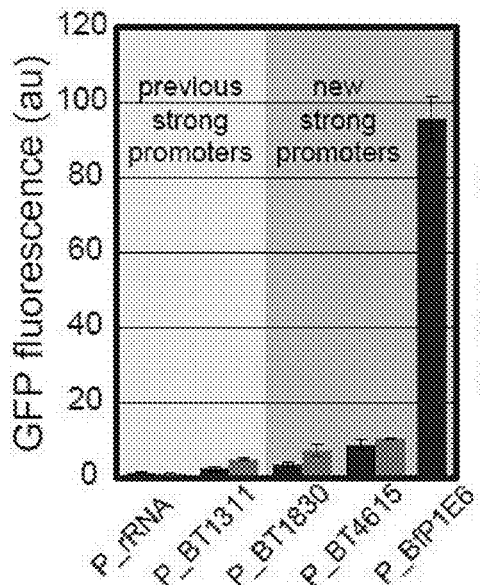
FIG. 2a-2f. Identification of a phage promoter capable of high protein expression.
Figure 6:
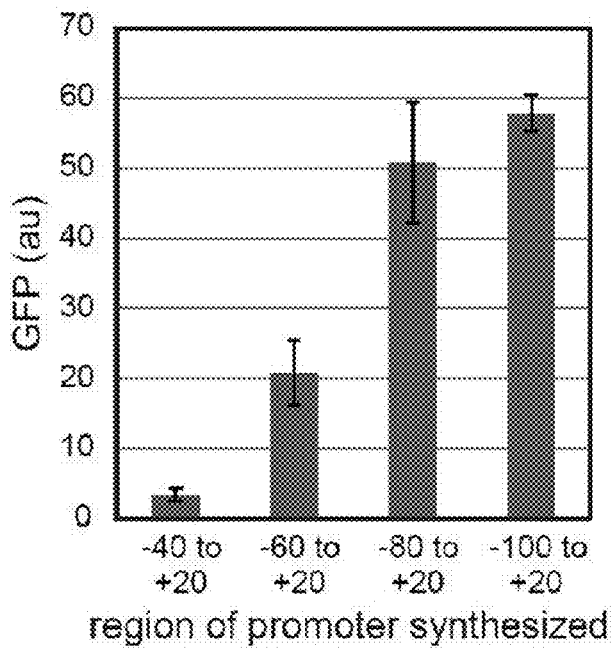
FIG. 6. Influence of phage promoter length on protein expression. The phage promoter length, in base-pairs, used to drive GFP expression is indicated with positions relative to the translation start site. Error bars represent the 95% confidence interval from 3 biological replicates.
Figure 7:
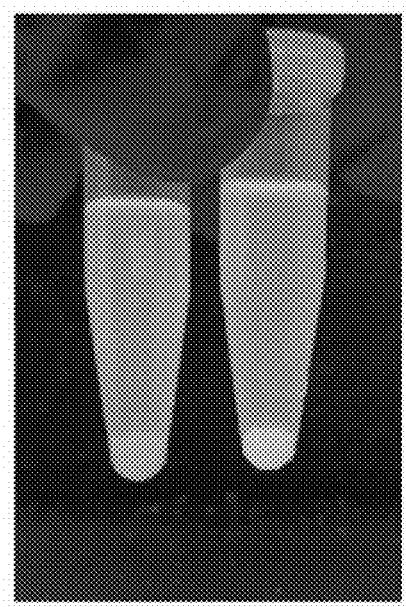
FIG. 7. $P_{BfP1E6}$-driven GFP fluorescence from a single genomic copy was visible by eye. A cell pellet from non-GFP expressing Bt (left) was compared to a pellet with Bt harboring a $P_{BfP1E6}$-driven GFP expression construct (right) suspended over a UV box. The image is unprocessed.
Figure 9A:
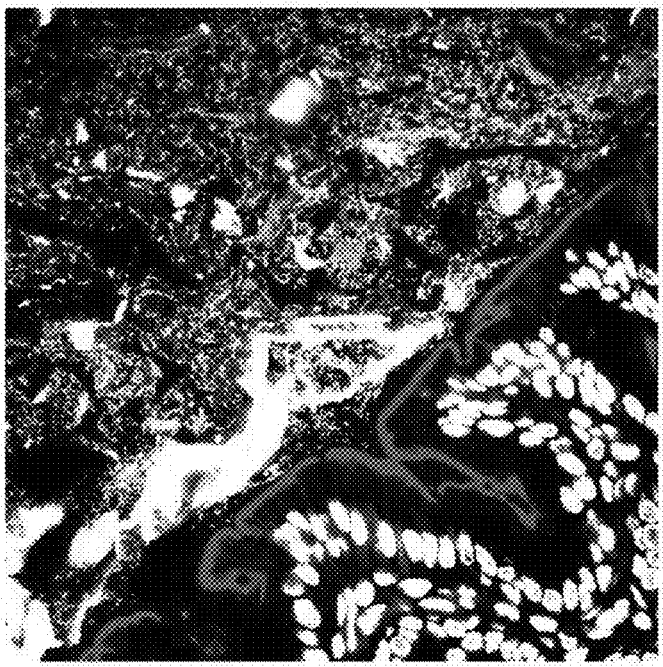
FIG. 9a-9e. Demonstration of the method for quantifying GFP positive cells from FIG. 2b-2c.
Figure 9B:
Figure 9C:
Figure 9D:
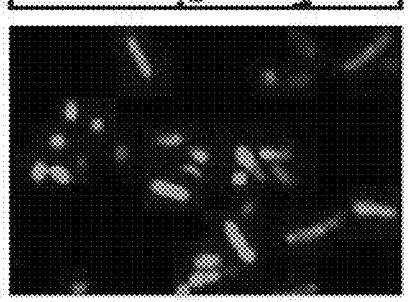
Figure 9E:
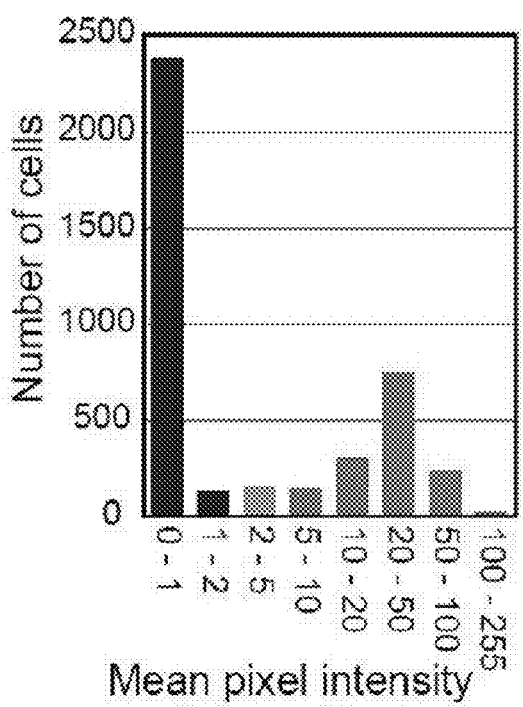

17 sequences with a high identity to the *Bacteroides* promoter consensus sequence (found within either of two phage genomes) were synthesized and tested to identify a strong promoter. The length of the highest strength phage promoter was varied and an upstream intrinsic terminator was used for reduced context dependence. The promoter sequence from −100 to +20 from the putative transcription start site, based on homology, produced the highest expression (FIG. 6). This phage promoter, here termed $P_{BfP1E6}$ (SEQ ID NO: 8), was compared to $P_{rRNA}$, the two strongest native Bt promoters identified from available transcriptional profiling data ($P_{BT1830}$ and $P_{BT4615}$), and the strongest promoter from a recent publication on synthetic biology tools for Bt, $P_{BT1311}$ (Parker et. al., Plasmid. 2012 September; 68(2):86-92). For each promoter tested, an A/T-rich RBS library of 192 RBSs was screened and the strongest RBS constructs for each promoter were compared. Strains with $P_{BfP1E6}$-driven expression produce fluorescence approximately 10-fold higher than the next highest promoter, $P_{BT4615}$, 40-fold higher than $P_{BT1311}$, and 70-fold higher than $P_{rRNA}$ (FIG. 2a, black bars). This was repeated using the RBS optimized for the phage promoter with each other promoter giving similar results (FIG. 2a, grey bars). Although recent published attempts to express detectable levels of GFP in Bacteroides have been unsuccessful, the use of both the AT-rich RBS library and the phage promoter exhibited strong GFP expression from a single genomic integration that can be easily detected by eye under UV light (FIG. 7).

Characterizing the Phage Promoter

Figure 2B:
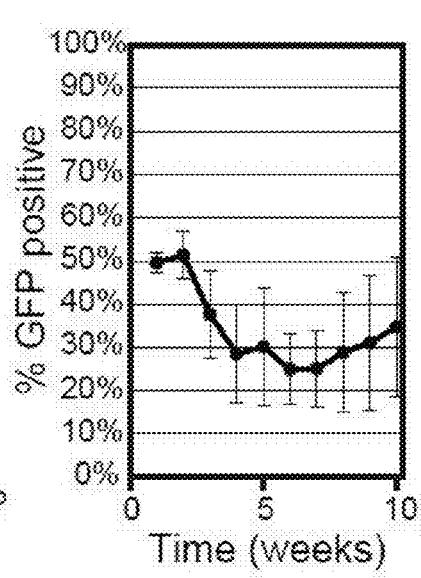
Figure 2C:
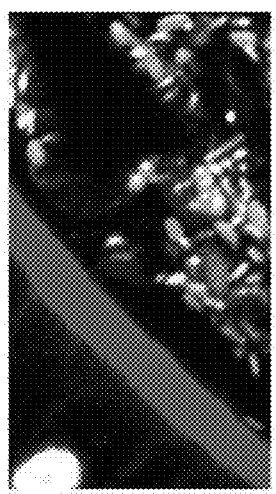
Figure 10:
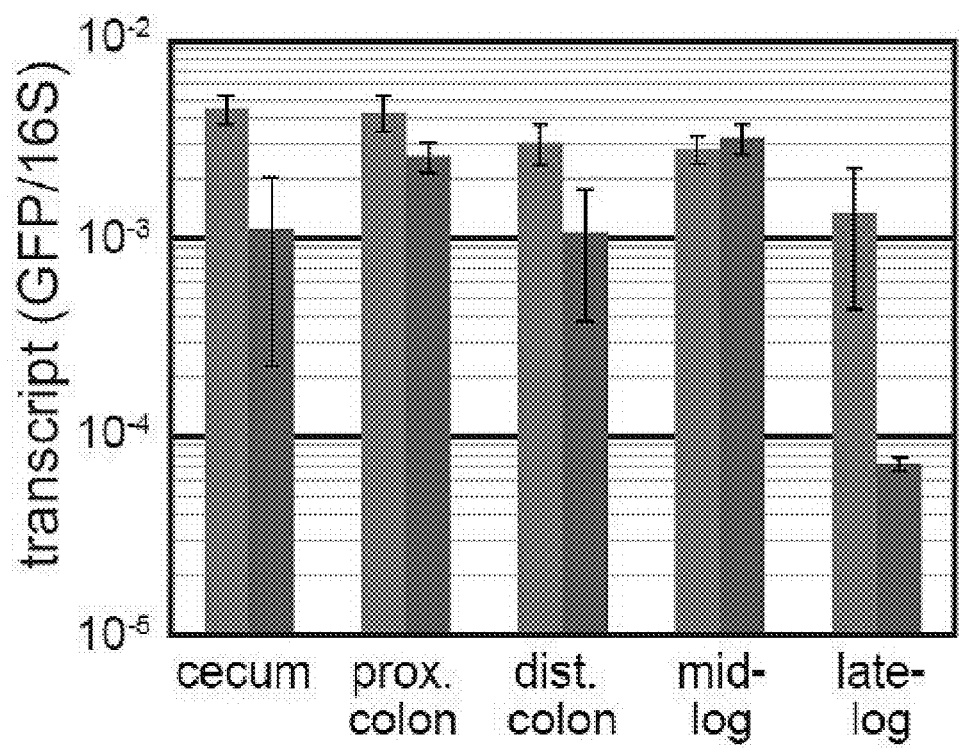
FIG. 10. Transcript abundance at various locations along the gut and in different growth phases in culture were compared for GFP driven by either $P_{BfP1E6}$ or $P_{rRNA}$. RT-qPCR reading of promoter specific transcript amplification, GFP, was normalized by 16 S rRNA specific (not overlapping with $P_{rRNA}$) transcript amplification. $P_{BfP1E6}$ transcript measurements (left bars) varied by less than four-fold across all conditions, while $P_{rRNA}$ measurements (right bars) varied by more than 40-fold. Error bars represent the 95% confidence interval from different mice or biological replicates.

Assessed next was how reliably the phage promoter functions in the gut and whether high protein expression results in a loss of Bt fitness. In culture, a 50:50 mix of the high GFP expression ($P_{BfP1E6}$) Bt strain and a non-expressing control Bt strain showed no significant difference in relative abundance after four successive growth cycles (FIG. 8). Next, a 50:50 mix of the two strains was inoculated into germ-free mice (n=5), to assess the fitness burden of high, constitutive protein expression in vivo. No difference in abundance between the strains was observed over the course of 14 days, with a small reduction from 50% to 35% during the next eight weeks (FIG. 2b). Imaging of the distal colon at day 71 post-colonization revealed a strong endogenous GFP fluorescence signal in ~37% of the Bt (FIG. 2C and FIG. 9). Achieving high expression with this minimal fitness burden enables a wide range of novel applications, including detection of reporter expression with in vivo imaging. To understand transcriptional variability of the phage promoter under different in vivo and in vitro conditions, transcript levels were measured at different growth phases in culture and from different locations in gnotobiotic mice. Transcripts, measured via qPCR, from $P_{BfP1E6}$ were relatively similar in all gut locations and culture conditions tested with less than a 4-fold maximum difference, while PA transcripts decreased more than 40-fold between mid-log and late-log growth phases (FIG. 10).

Figure 2D:
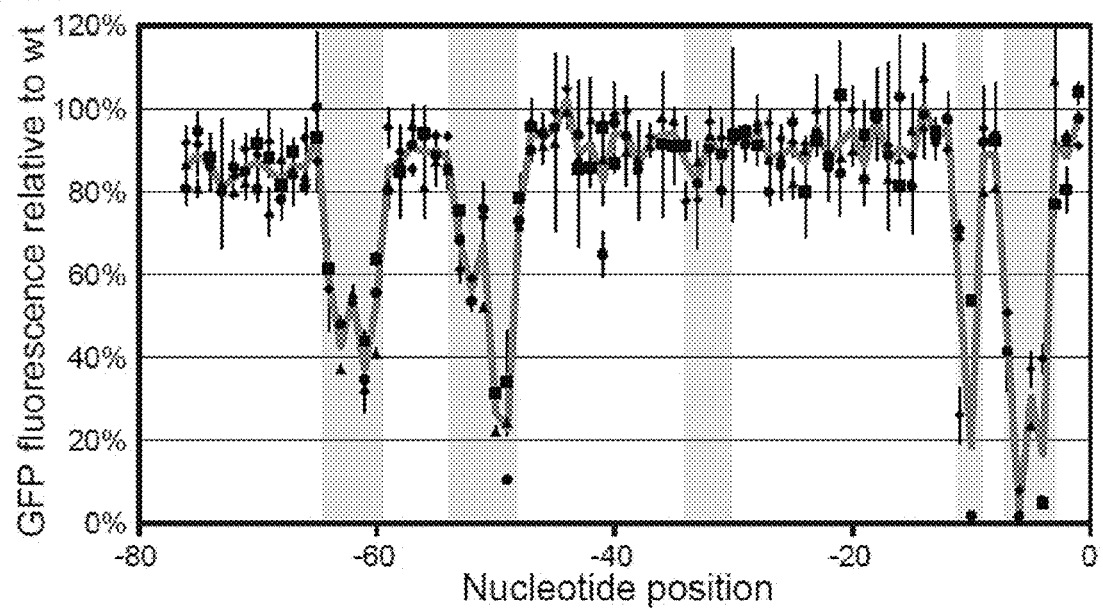
Figure 11A:
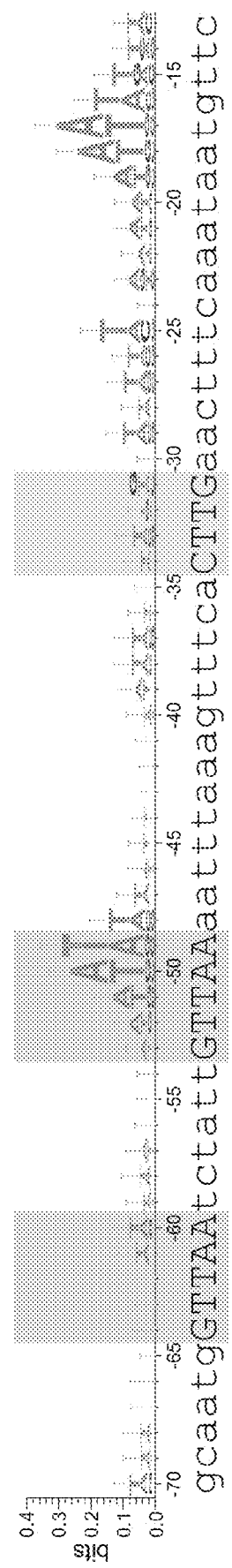
FIG. 11a-11d.

To characterize how changes in the phage promoter sequence influence expression levels, Bt strains were constructed that each expressed GFP with a single mutation in the promoter, for 94% of all possible mutations in the 76 residues upstream of the transcription start site (FIG. 2d). Of the 214 strains constructed, no single mutation significantly increased expression, suggesting that native sequence achieves a local optimum for expression. Based on previous literature, mutations in the residues between −4 and −54, particularly in the −7 and −33 regions (FIG. 2d highlighted in blue), were expected to most influence promoter activity. However, the −33 position was far less important than expected, and previously uncharacterized sequences at −49 to −53 and −60 to −64 (FIG. 2d highlighted in red) were important for promoter activity. Consistent with these data, the −51 region appears to be more highly conserved in native Bt promoters than the −33 region (FIG. 11a). The region upstream of the −33 is expected to contain the UP-element, which remains to be characterized in the Bacteroidetes phylum. The spacing of the GTTAA motifs within these two newly identified regions is consistent with the proximal (~−42) and distal (~−52) UP-elements of E. coli, but shifted in location by approximately 10 nucleotides. Table 5 depicts results from the above experiments.

TABLE 5

Strength of various tested promoter sequences (listed mutants are relative to the wild type sequence set forth in SEQ ID NO: 150).

| Mutant | Strength | SEQ ID NO |
|---|---|---|
| WT | 1.00 | 150 |
| T-76A | 0.92 | 151 |
| T-76C | 0.81 | 152 |
| T-76G | 0.86 | 153 |
| T-75A | 0.91 | 154 |
| T-75C | 0.94 | 155 |
| T-75G | 0.81 | 156 |
| G-74A | 0.86 | 157 |
| G-74C | 0.87 | 158 |
| G-74T | 0.88 | 159 |
| T-73C | 0.80 | 160 |
| T-73G | 0.82 | 161 |
| T-72A | 0.84 | 162 |
| T-72C | 0.86 | 163 |
| T-72G | 0.80 | 164 |
| T-71A | 0.90 | 165 |
| T-71C | 0.85 | 166 |
| T-71G | 0.82 | 167 |
| G-70A | 0.89 | 168 |
| G-70C | 0.80 | 169 |
| G-70T | 0.92 | 170 |
| C-69A | 0.92 | 171 |
| C-69G | 0.75 | 172 |
| C-69T | 0.88 | 173 |
| A-68C | 0.78 | 174 |
| A-68G | 0.88 | 175 |
| A-68T | 0.81 | 176 |
| A-67C | 0.84 | 177 |
| A-67G | 0.85 | 178 |
| A-67T | 0.89 | 179 |
| T-66A | 0.93 | 180 |
| T-66C | 0.81 | 181 |
| T-66G | 0.84 | 182 |
| G-65A | 0.87 | 183 |
| G-65C | 1.00 | 184 |
| G-65T | 0.93 | 185 |
| G-64A | 0.56 | 186 |
| G-64T | 0.61 | 187 |
| T-63C | 0.48 | 188 |
| T-63G | 0.37 | 189 |
| T-62A | 0.53 | 190 |
| T-62G | 0.55 | 191 |
| A-61C | 0.35 | 192 |
| A-61G | 0.33 | 193 |
| A-61T | 0.44 | 194 |
| A-60C | 0.56 | 195 |
| A-60G | 0.41 | 196 |
| A-60T | 0.64 | 197 |
| T-59A | 0.95 | 198 |
| T-59C | 0.80 | 199 |
| T-59G | 0.82 | 200 |
| C-58A | 0.90 | 201 |
| C-58G | 0.87 | 202 |
| C-58T | 0.85 | 203 |
| T-57A | 0.85 | 204 |
| T-57C | 0.91 | 205 |
| T-57G | 0.96 | 206 |
| A-56C | 0.93 | 207 |
| A-56G | 0.81 | 208 |
| A-56T | 0.94 | 209 |
| T-55A | 0.93 | 210 |
| T-55C | 0.89 | 211 |
| T-55G | 0.87 | 212 |
| T-54A | 0.93 | 213 |
| T-54C | 0.85 | 214 |
| T-54G | 0.85 | 215 |
| G-53A | 0.61 | 216 |
| G-53C | 0.68 | 217 |
| G-53T | 0.75 | 218 |
| T-52A | 0.59 | 219 |
| T-52C | 0.53 | 220 |
| T-51A | 0.74 | 221 |
| T-51C | 0.76 | 222 |
| T-51G | 0.52 | 223 |

TABLE 5-continued

Strength of various tested promoter sequences (listed mutants are relative to the wild type sequence set forth in SEQ ID NO: 150).

| Mutant | Strength | SEQ ID NO |
|---|---|---|
| A-50G | 0.22 | 224 |
| A-50T | 0.31 | 225 |
| A-49C | 0.10 | 226 |
| A-49G | 0.24 | 227 |
| A-49T | 0.34 | 228 |
| A-48C | 0.73 | 229 |
| A-48G | 0.72 | 230 |
| A-48T | 0.79 | 231 |
| A-47C | 0.90 | 232 |
| A-47G | 0.97 | 233 |
| A-47T | 0.96 | 234 |
| T-46A | 0.94 | 235 |
| T-46C | 0.94 | 236 |
| T-46G | 0.91 | 237 |
| T-45A | 0.99 | 238 |
| T-45C | 0.95 | 239 |
| T-45G | 0.92 | 240 |
| T-44A | 1.05 | 241 |
| T-44G | 0.99 | 242 |
| A-43C | 0.94 | 243 |
| A-43G | 0.88 | 244 |
| A-43T | 0.85 | 245 |
| A-42G | 0.97 | 246 |
| A-42T | 0.86 | 247 |
| A-41C | 0.65 | 248 |
| A-41G | 0.88 | 249 |
| A-41T | 0.95 | 250 |
| G-40A | 0.99 | 251 |
| G-40C | 0.96 | 252 |
| G-40T | 0.87 | 253 |
| T-39A | 0.99 | 254 |
| T-39C | 0.93 | 255 |
| T-39G | 0.90 | 256 |
| T-38A | 0.87 | 257 |
| T-38C | 0.85 | 258 |
| T-38G | 0.88 | 259 |
| T-37A | 0.93 | 260 |
| T-37G | 0.91 | 261 |
| C-36A | 0.91 | 262 |
| C-36G | 0.98 | 263 |
| C-36T | 0.91 | 264 |
| A-35G | 0.97 | 265 |
| A-35T | 0.91 | 266 |
| C-34A | 0.78 | 267 |
| C-34G | 0.92 | 268 |
| C-34T | 0.91 | 269 |
| T-33A | 0.78 | 270 |
| T-33C | 0.82 | 271 |
| T-33G | 0.87 | 272 |
| T-32A | 0.97 | 273 |
| T-32C | 0.90 | 274 |
| T-32G | 0.93 | 275 |
| G-31A | 0.93 | 276 |
| G-31C | 0.80 | 277 |
| G-31T | 0.89 | 278 |
| A-30C | 0.94 | 279 |
| A-30G | 0.92 | 280 |
| A-30T | 0.94 | 281 |
| A-29C | 0.91 | 282 |
| A-29G | 0.93 | 283 |
| A-29T | 0.94 | 284 |
| C-28A | 0.95 | 285 |
| C-28G | 0.97 | 286 |
| C-28T | 0.91 | 287 |
| T-27A | 0.96 | 288 |
| T-27C | 0.80 | 289 |
| T-27G | 0.88 | 290 |
| T-26A | 0.93 | 291 |
| T-26C | 0.86 | 292 |
| T-26G | 0.88 | 293 |
| T-25A | 0.92 | 294 |
| T-25C | 0.97 | 295 |
| T-25G | 0.82 | 296 |
| C-24A | 0.91 | 297 |
| C-24G | 0.90 | 298 |
| C-24T | 0.80 | 299 |
| A-23C | 0.94 | 300 |
| A-23G | 1.00 | 301 |
| A-23T | 0.92 | 302 |
| A-22C | 0.86 | 303 |
| A-22G | 0.89 | 304 |
| A-22T | 0.88 | 305 |
| A-21C | 0.84 | 306 |
| A-21G | 0.88 | 307 |
| A-21T | 1.03 | 308 |
| T-20A | 1.00 | 309 |
| T-20G | 0.90 | 310 |
| A-19C | 0.83 | 311 |
| A-19G | 0.83 | 312 |
| A-19T | 0.94 | 313 |
| A-18C | 0.98 | 314 |
| A-18G | 0.99 | 315 |
| A-18T | 0.98 | 316 |
| T-17A | 0.91 | 317 |
| T-17C | 0.89 | 318 |
| T-17G | 0.83 | 319 |
| G-16A | 0.87 | 320 |
| G-16C | 1.03 | 321 |
| G-16T | 0.81 | 322 |
| T-15A | 0.88 | 323 |
| T-15C | 0.81 | 324 |
| T-15G | 0.95 | 325 |
| T-14A | 0.95 | 326 |
| T-14C | 0.99 | 327 |
| T-14G | 1.08 | 328 |
| C-13A | 0.92 | 329 |
| C-13G | 0.94 | 330 |
| C-13T | 0.94 | 331 |
| T-12A | 0.90 | 332 |
| T-12C | 0.97 | 333 |
| T-12G | 0.97 | 334 |
| T-11A | 0.26 | 335 |
| T-11C | 0.71 | 336 |
| T-11G | 0.69 | 337 |
| A-10C | 0.02 | 338 |
| A-10G | 0.00 | 339 |
| A-10T | 0.54 | 340 |
| T-9A | 0.95 | 341 |
| T-9C | 0.92 | 342 |
| T-9G | 0.80 | 343 |
| A-8C | 0.93 | 344 |
| A-8G | 0.81 | 345 |
| A-8T | 0.92 | 346 |
| T-7A | 0.51 | 347 |
| T-7C | 0.41 | 348 |
| T-6A | 0.08 | 349 |
| T-6C | 0.02 | 350 |
| T-6G | 0.00 | 351 |
| T-5A | 0.37 | 352 |
| T-5G | 0.24 | 353 |
| G-4A | 0.40 | 354 |
| G-4C | 0.05 | 355 |
| G-4T | 0.05 | 356 |
| C-3G | 1.07 | 357 |
| C-3T | 0.77 | 358 |
| A-2G | 0.93 | 359 |
| A-2G | 0.92 | 360 |
| A-2T | 0.80 | 361 |
| G-1A | 0.91 | 362 |
| G-1C | 0.97 | 363 |
| G-1T | 1.04 | 364 |

Heterologous Transcription by the Phage Promoter Exceeds Levels Obtainable by the Strong Native rRNA Promoter

*Bacteroides* harboring a cassette for expressing GFP driven by either the phage promoter (SEQ ID NO: 8) or the ribosomal RNA promoter (SEQ ID NO: 511, ggctacttttgcacccgctttccaagagaagaaagccttgataaattgact-
tagtgtaaaagcaagtgtctgcttaaccataagaac aaaaaaacttcga-
taaagttttggaagataaagctaaaagttcttatctttgcagtccgattcgcaaagaaa
aggtgttacgcttttc ttctttaccttctttcccttttcgctaagagagcctgaaaaac-
gatagaaaaagaaaaacgaaaaaaaaacttccgaaaatatttgg tagt-
taaaataaaacctcttacctttgcacccgcttttaaaacgaaagcaagatgttcttt-
gaaatattgataaacaatacaagtagt
acaagaaaaaaatagaaccgtcaatacttgtcttatatgtagtaatatgtatgagt-
cataaggtattaatgaagtcaataaattgtac ggcatcct-
gaacagagcaaaaatcagctttatgctgactaacaatacttttacaatgaagagttt-
gatcctggctcag) were grown in vitro and in vivo as described herein. To compare the strength of the phage promoter to the ribosomal RNA promoter, a native promoter that is expected to be among the most highly expressed native promoters, transcription rates of each promoter were determined via RT-qPCR as described herein. In all measured gut locations and in saturated culture conditions, transcripts produced from the phage promoter significantly exceeded those produced from the ribosomal RNA promoter (FIG. 10).

Heterologous Protein Driven by the Phage Promoter Exceeds Levels Achieved with the Strongest Native Promoters by Ten-Fold To achieve high levels of protein expression, a strong RBS was used in addition to using a strong promoter. Strong RBSs were generated from screening an RBS library with a motif based on the RBSs found in a *Bacteroides* specific phage (SEQ ID NO: 375). Previously, expression of fluorescent proteins from *Bacteroides* has not been reported, however, use of the RBS library (SEQ ID NO: 375) increased expression from the rRNA promoter to 38% higher than background autofluorescence of unmodified cells when measured as described herein. Screening a number of additional native promoters produced higher expression, including up to a 950% increase in fluorescence relative to the autofluorescence of unmodified cells. Fluorescence from the GFP driven by the phage promoter however exceed that produced by any of the strong native promoters tested by ten-fold with an approximately 9500% increase in fluorescence relative to the autofluorescence of unmodified cells.

Heterologous Protein Expression from the Phage Promoter Produces Approximately 14,000 nM of Cytoplasmic Protein To determine the absolute protein expression level achievable with the phage promoter, a standard curve was generated with purified luciferase protein of a known concentration and compared to luciferase driven by the phage promoters and several variants (SEQ ID NO: 1-8), as described herein. The protein concentrations from these constructs range from approximately 0.5 to 14,000 nM. Since the phage promoter is approximately ten times the strength of any measured native promoter, cytoplasmic protein concentrations of 1,400 nM or less are expected to be achievable by native promoters.

Generating Expression Predictably Functioning Promoter Variants

Figure 2E:
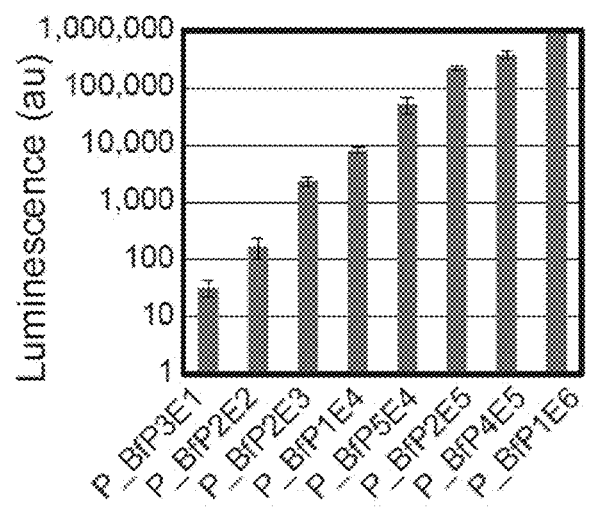
Figure 2F:
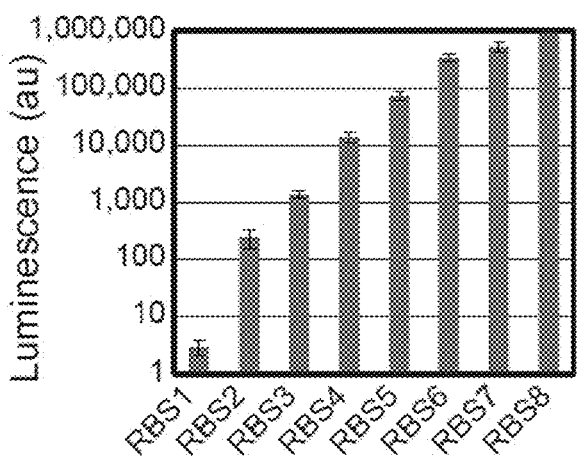

Using data from the mutational analysis a set of eight constitutive promoters were created that span a 30,000-fold expression range by introducing single or multiple mutations in $P_{BfP1E6}$ (FIG. 2e). As a complementary means of controlling expression levels, eight RBSs spanning more than 5 orders of magnitude were also generated (FIG. 2f). As protein expression level is the product of promoter and RBS strength, in combination these promoters and RBSs give a theoretical expression range of ten billion, well beyond the range of highly sensitive assays. The eight constitutive promoters in this set differ by only a few residues upstream of transcription initiation and thus are expected to function predictably when driving different protein-RBS combinations. Because core transcriptional and translational machinery is highly conserved, these expression tools should function predictably across the entire *Bacteroides* genus.

Figure 3A:
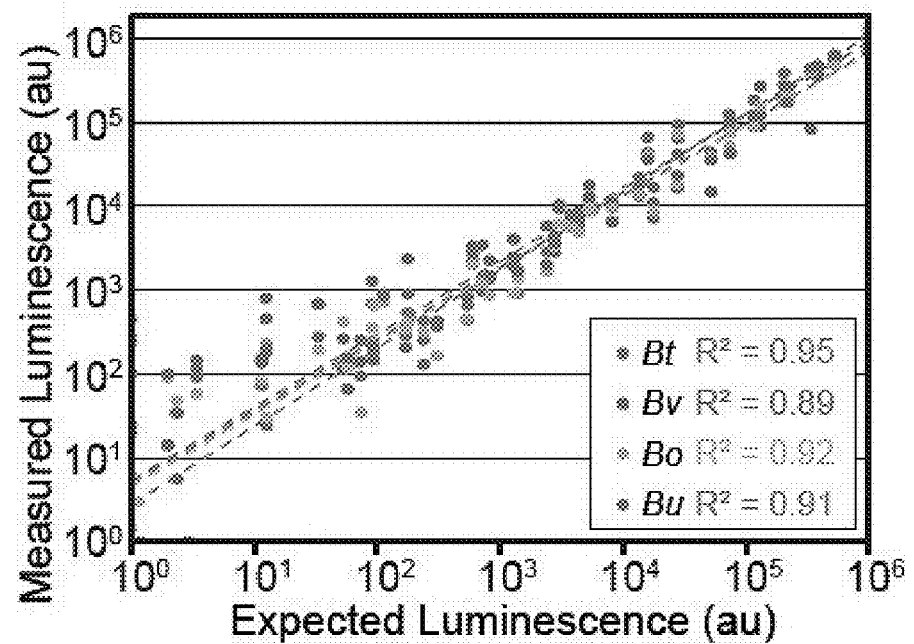
FIG. 3a-3f. Phage promoter set can predictably tune protein expression across the Bacteroides genus, allowing simultaneous strain identification in vivo.
Figure 12:
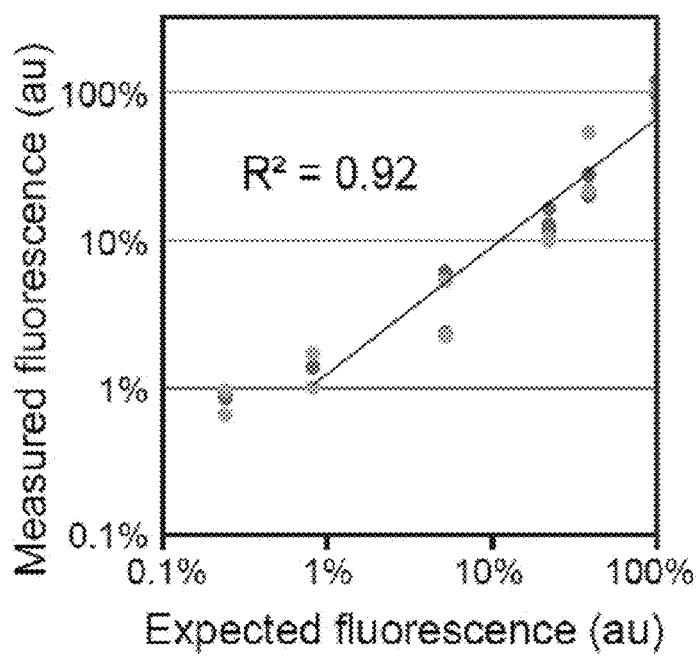
FIG. 12. The phage promoter set produced GFP expression matching expectation from characterization with luciferase. The strongest 6 phage promoter variants from FIG. 2e drove GFP expression in Bt (blue), By (red), Bo (green), Bf (purple) and Be (orange). GFP expression, relative to $P_{BfP1E6}$ in Bt, is plotted against luciferase expression relative to $P_{BfP1E6}$ in Bt (FIG. 2e). A linear fit of log 10 values of the 5 strongest promoters, with the weakest promoter excluded due the high contribution of background auto-fluorescence (0.8%), gave an $R^2$ of 0.92.

56 promoter-RBS combinations were constructed (promoters of SEQ ID NOs: 2-8, in combination with RBSs of SEQ ID NOs: 11-18, in all pairwise combinations, e.g., see Table 4 above) and luciferase expression of genomically integrated constructs in four species, Bt, Bv, Bo and Bu, was measured to determine the extent of predictable expression. The expected expression level for the >200 strains was calculated by multiplying the relative promoter and RBS strengths determined in Bt (FIG. 2E-2F). A high correlation was found between expected and measured expression over a million-fold range in all four species with $R^2$ ranging from 0.95 in Bt to 0.89 in By (FIG. 3A). Additionally, the promoters produce the expected relative levels of GFP in Bt, Bv, Bo, Bf, and *Bacteroides eggerthii* (Be) (FIG. 12).

Endogenous Fluorescent Imaging in the Mouse Gut

Figure 3B:
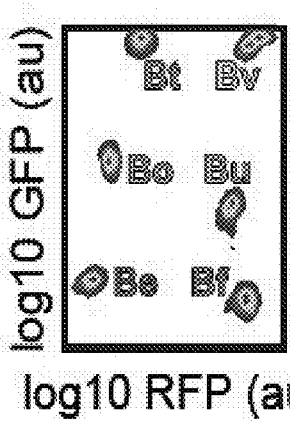
Figure 3C:
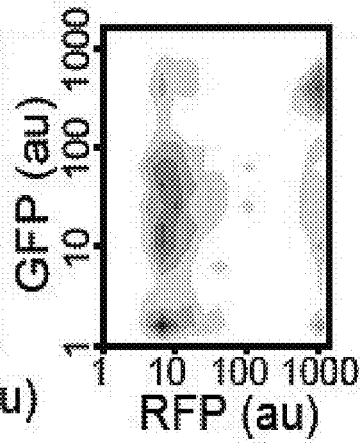
Figure 3D:
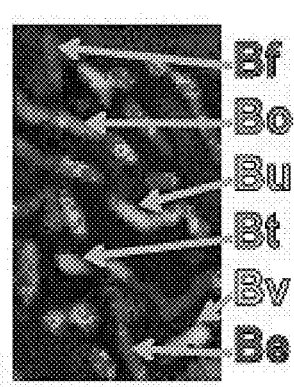
Figure 3E:
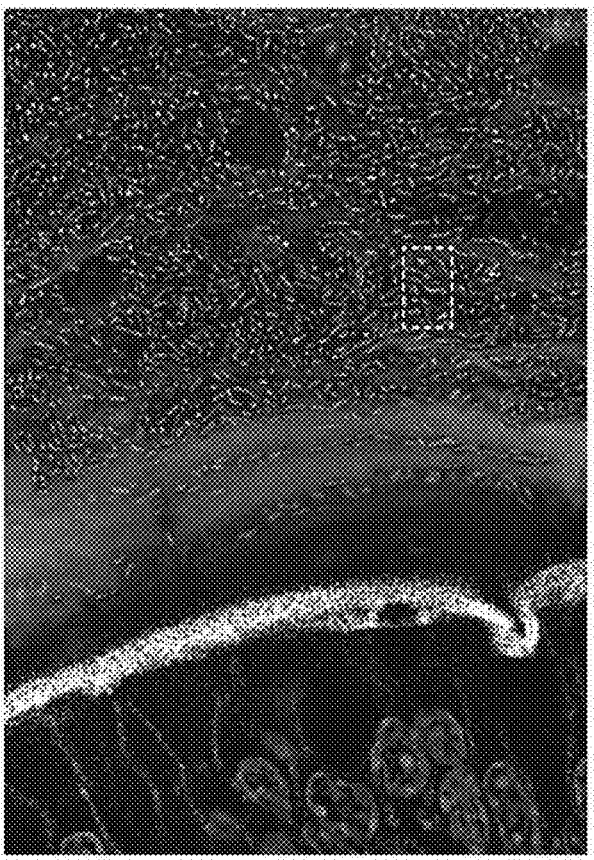
Figure 3F:
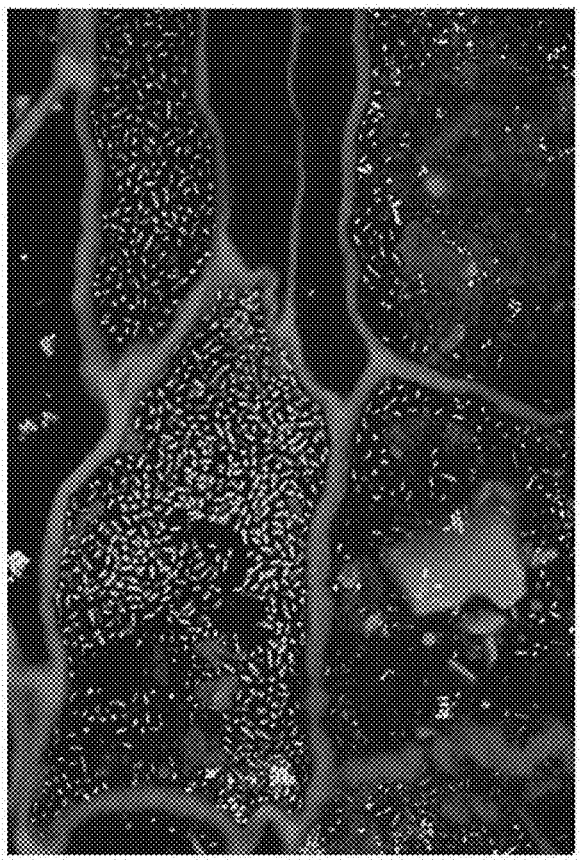
Figure 13A:
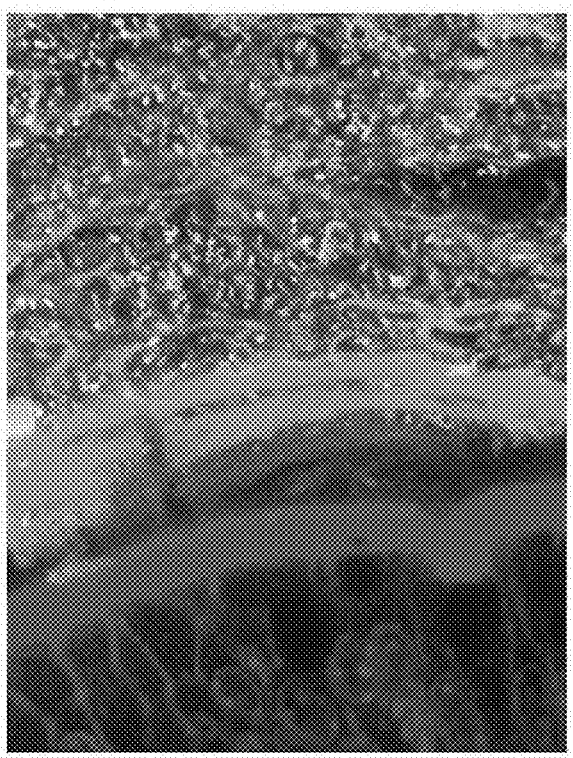
FIG. 13a-13b. Distal colon image (from FIG. 3e) prior to processing and transformation.
Figure 13B:
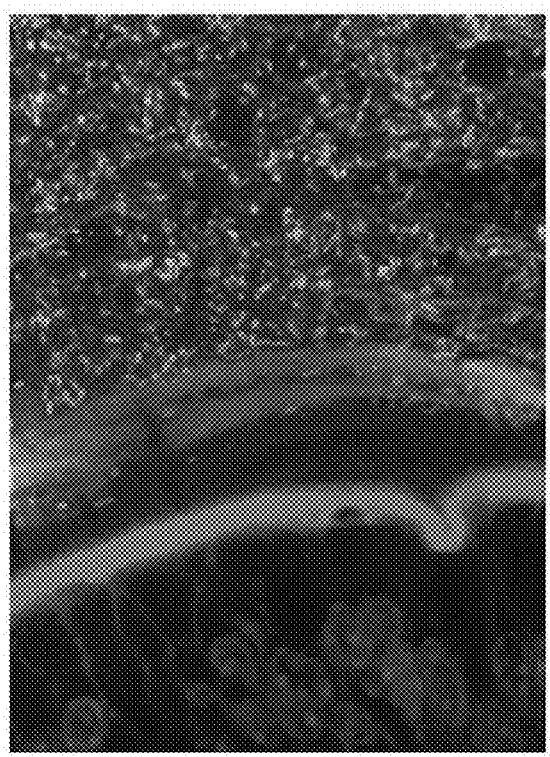
Figure 14A:
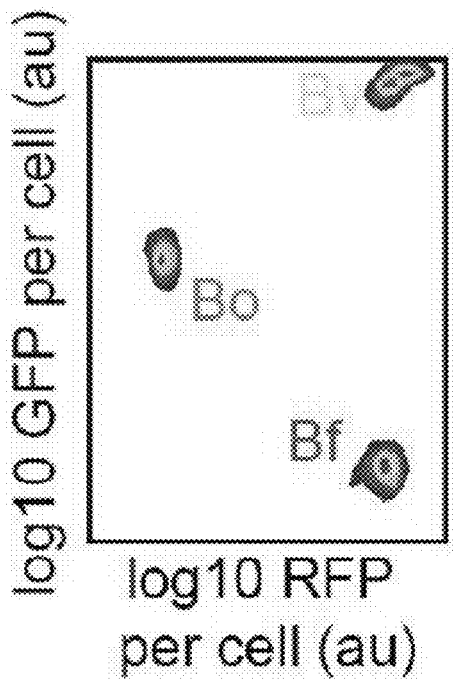
FIG. 14a-14c. A control three-member community for estimating error.
Figure 14B:
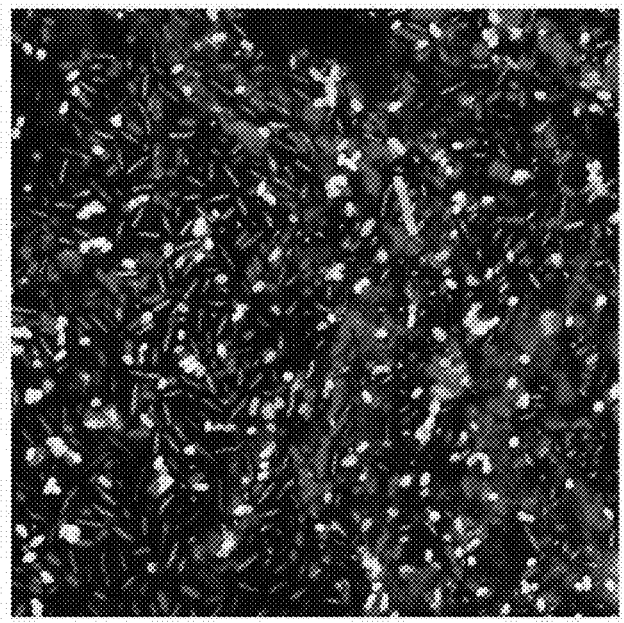
Figure 14C:
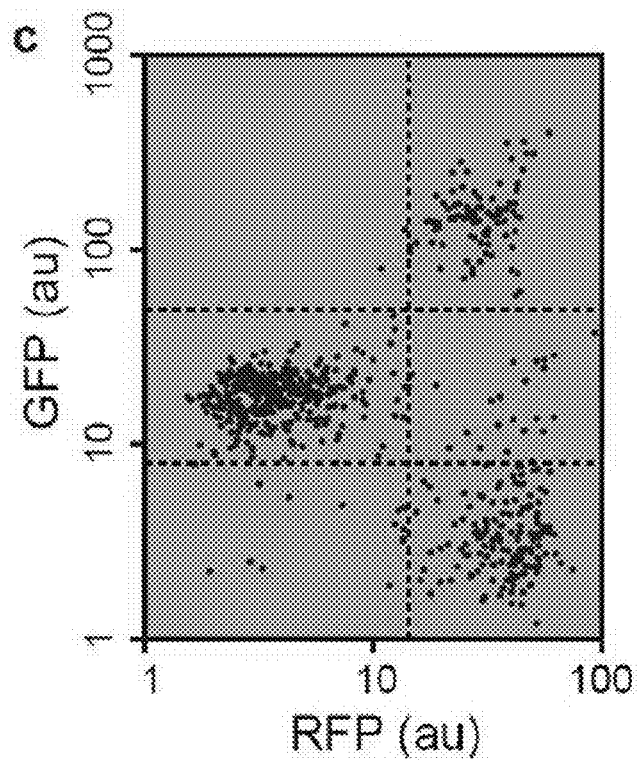

Six different *Bacteroides* species were engineered using the above panel of promoters to produce a unique fluorescent signature that could be imaged in vivo. One of three levels of GFP expression plus one of two levels of mCherry expression were genomically integrated into each species. Strain level differentiation in mixed communities, which is difficult using established methods such as fluorescence in situ hybridization (FISH), was achieved at the single cell level (FIG. 3B). Either the full set of six engineered species or a subset of three species were next introduced into germ-free mice. After 14 days of colonization, mice were sacrificed, distal colon sections were imaged and single-cell fluorescent profiles were quantified (FIG. 3C and FIG. 13 and FIG. 14). Comparison of the six-species and three-species communities indicated a low cell identification error (~6%) in the six member community (FIG. 14). Transformation of fluorescent signatures enabled visual differentiation of six co-residing *Bacteroides* species within the gut (FIG. 3D-E). *Bacteroides* species differentially localized in dietary plant material within the gut at one-day post colonization (FIG. 3F), demonstrating the utility of fluorescent-protein-expressing species along with conventional staining methods in detailed investigations of spatial and temporal microbiota dynamics.

Materials and Methods

High throughput plasmid construction, conjugation and integration. Basic part plasmids were created by cloning each part, flanked with the BsaI restriction site and 4-base overhangs specified in FIG. 4, into a standard cloning vector, pWW3056, using NotI/SbfI restriction sites. See FIG. 15 and FIG. 16 (Tables 2 and 3) for a list of oligonucleotides, basic part plasmids, and their corresponding sequences, respectively. Golden Gate reactions were carried out according to standard procedures, using any combination of basic part plasmids above, synthesized sequences, PCR products, or PNK-treated annealed oligonucleotides (annealed to generate BsaI digestion equivalent overhangs). Completed Golden Gate reactions of 4 µL were transformed with addition of 20 µL of chemically competent *E. coli* S17-1 cells (mid-log cells resuspended 1:20 in TSS/KCM: LB medium with 8.3% PEG-3350, 4.2% DMSO, 58 mM $MgCl_2$, 167 mM $CaCl_2$ and 457 mM KC), followed by a 90 second heat shock at 42° C., recovery at 37° C. for 30 minutes, a dilution into 600 µL LB medium with Ampicillin (150 µg/mL) in a deep well 96-well plate (Corning 07-200-700) and aerobic growth at 37° C. A *Bacteroides* culture was prepared with overnight anaerobic growth in trypticase yeast extract-glucose (TYG) growth medium. At mid to late log growth, 200 µL of the transformed S17-1 cells were spun down, resuspended with 10 µL of a 1:10 concentration of the *Bacteroides* culture, and added to a deep well 96-well plate containing 400 µL of solidified Brain Heart Infusion Blood Agar (BHI-BA) per well. After at least 16 hours, the lawn of S17-1 and *Bacteroides* were resuspended in 400 µL of TYG by vortex or pipetting, 200 µL of the resuspension was spun down and resuspended in 15 µL TYG and several dilutions in TYG were made. 3 µL of the resuspension and its dilutions were spotted onto a 120×120 mm square petri dish containing BHI-BA plus the appropriate antibiotics (200 µg/mL gentamycin, and 25 µg/mL erythromycin or 2 µg/mL tetracycline). Of the species tested here, Bf produces the fewest and By produces the most transformants. *Bacteroides* colonies can be picked after a 24 hour anaerobic incubation at 37° C.

Assessing high-throughout cloning and genomic integration pipeline success rates. The likelihood of obtaining a colony with a correctly assembled, integrated plasmid was extracted from phenotypic data (FIG. 3a). The 40 constructs that produce within 10,000-fold of the maximum expression were considered for each of the four species. Four biological replicate *Bacteroides* colonies were picked for each construct within each species, and each was expected to be derived from a uniquely generated plasmid since conjugation to *E. coli* transformants was performed in batch. Replicates with a deviation from the median by at least an order of magnitude were considered to be incorrectly assembled. All such misassembles were at least 50-fold lower than expected and close to background levels of luminescence. Samples with substantially lower growth as determined by $OD_{600\ nm}$ were excluded from the analysis, although inclusion of wells with little or no growth only substantially impacted By calculations with a reduction to 90% correct.

Culture reporter expression and fluorescent assays. To assay *Bacteroides* strain reporter activity, glycerol stocks of *Bacteroides* strains were streaked out on BHI blood agar plates with the appropriate antibiotics (200 µg/mL gentamycin, and 25 µg/mL erythromycin or 2 µg/mL tetracycline), and after a 24-30 hour anaerobic incubation at 37° C., at least 3 colonies were picked into TYG with antibiotics (25 µg/mL erythromycin or 2 µg/mL tetracycline) and grown anaerobically at 37° C. for 14-20 hours. Endogenous fluorescence from super-folding GFP and mCherry was measured after twice spinning cultures down and resuspending in PBS followed by oxygen exposure for at least 60 minutes. The Nano-Glo Luciferase Assay System (Promega) was used for luciferase assays. Fluorescence, $OD_{600}$ and luminescence readings were taken on a TECAN Infinite 200 PRO microplate reader with a 5 nm band pass excitation/emission of 488/510 and 580/610 nm for GFP and mCherry respectively.

Gnotobiotic mouse experiments. Mouse experiments in this study were performed in strict accordance with a Protocol for Care and Use of Laboratory Animals approved by the Stanford University Administrative Panel of Laboratory Animal Care. Germ-free Swiss Webster mice (Taconic) were maintained in gnotobiotic isolators on a 12 hour light cycle and fed ad libitum a standard autoclaved chow diet (LabDiet 5K67). Mice were inoculated via oral gavage with ~$10^8$ total *Bacteroides* CFU, either a single strain or equal proportions of mixed strains. Fecal pellets were plated on BHI-BA with gentamycin and erythromycin, grown at least 24 hours, and individual colonies were picked for fluorescent assay based enumeration. After one day (FIG. 3f), 2 weeks (FIG. 3d-h) or 10 weeks (FIG. 2c) mice were sacrificed using $CO_2$ asphyxiation and cervical dislocation in accordance with approved protocols and tissue was immediately harvested and processed as described below.

Fitness assays. Culture fitness assays were conducted by streaking out glycerol stocks of GFP expressing or non-expressing Bt, picking two colonies of each and growing in TYG+erythromycin (25 µg/mL) overnight, subculturing each strain and growing to mid-log, and then independently combining the two sets of cultures at a 1:1 ratio followed by growth to stationary phase. Each day for 4 days the cultures were subsequently diluted 1:100 for overnight growth, then diluted 1:50 and sampled at mid-log during growth to stationary phase. At each mid-log timepoint, the cultures were sampled, centrifuged at 14,000×g, resuspended in an equal volume of PBS, and assayed for bulk GFP fluorescence relative to purely GFP-expressing or non-expressing cultures. In vivo fitness experiments were conducted by similarly preparing a mix of the two strains from overnight culture, and inoculating and maintaining mice as described above. Bacterial densities were determined using serial dilution of samples taken from fecal pellets of each mouse three times a week. Forty-eight colonies for each mouse at each timepoint were picked and assayed for fluorescence as described above and weekly data was averaged for each mouse to provide an average proportion of GFP expressing Bt for each mouse each week.

Transcript measurements. RNA was isolated with RNeasy kits (Qiagen) applied to either cecal or fecal contents treated with phenol-chloroform and bead beating, or cultures were treated with RNAprotect (Qiagen) and lysozyme as previously described. RNA was converted to cDNA with Superscript II (Invitrogen) followed by qRT-PCR analysis with SYBR Green (ABgene) in an MX3000P thermocycler (Stratagene). The normalized transcript levels, GFP/16 S, were determined by amplification of GFP and 16 S, with primers tggtgttcagtgctttgctc (SEQ ID NO: 376)/agctcaatgcggtttaccag (SEQ ID NO: 377) and cgttccattaggcagttggt (SEQ ID NO: 378)/caacccatagggcagtcatc (SEQ ID NO: 379) respectively.

Mutational analysis of phage promoter. For each promoter variant assayed, a unique strain was generated, as described above, using a three-piece Golden Gate assembly of a pair of PNK treated annealed oligonucleotides manufactured by Integrated DNA Technologies (typically two 28-base-pair oligonucleotides) containing the specific mutation, combined with upstream and downstream plasmid parts to create an expression plasmid identical to pWW3452 but with a single promoter mutation. The assembly and integration process was repeated three independent times to better identify outliers in expression due to errors in plasmid synthesis. All strains producing less than 75% the native promoter activity were sequence verified with PCR from genomic DNA and Sanger sequencing. 98% of the verified mutations outside of the highlighted regions of importance (FIG. 2d) produced over 75% of $P_{BfP1E6}$-driven fluorescence.

Figure 11B:
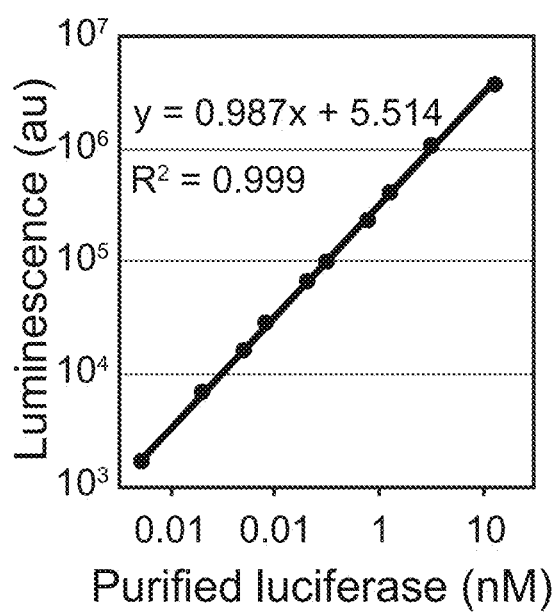
Figure 11C:
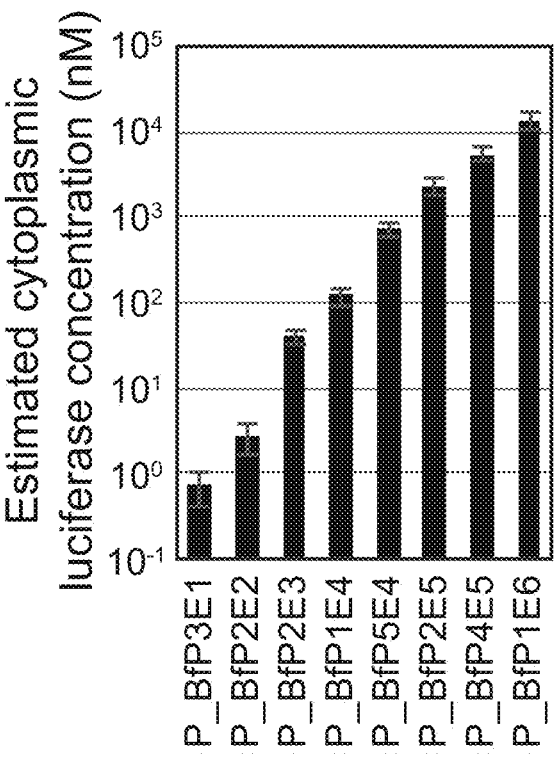
Figure 11D:
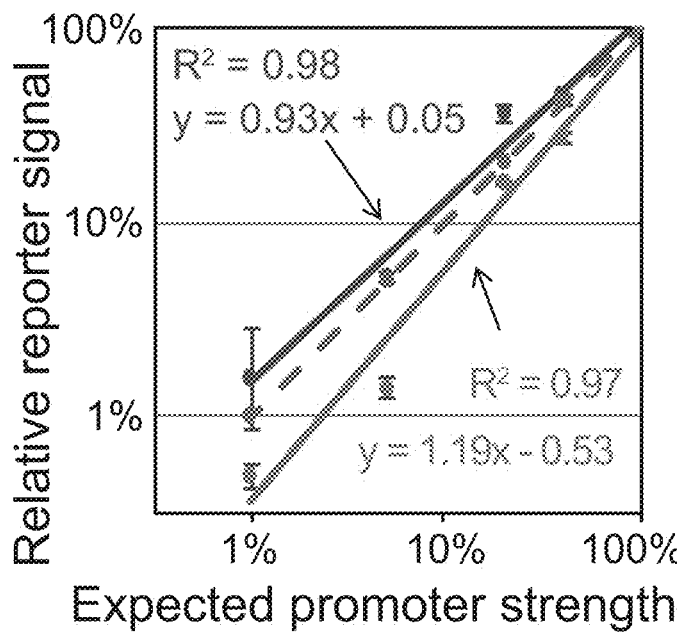

Absolute luciferase expression quantification. A standard curve for quantifying luciferase concentration was produced using purified luciferase protein (Promega; NanoLuc-Halotag Protein, 100 µg; tem #: CS188401). The luciferase protein (8 µg/µl; 54.2 kDa) was diluted either 1:2,000 or 1:20,000 into PBS+BSA, and serially diluted (1:4) in PBS+ BSA. Luminescence was measured with Nano-Glo Luciferase Assay System (Promega), and dilutions of between $8×10^3$ and $8.2×10^7$ produced reading within the linear range (FIG. 11b). Simultaneously, cultures were grown in triplicate and similarly assayed for luciferase as described above, as well as plated giving on average $5×10^6$ CFU/µl. Cells harboring the strongest phage promoter when diluted 1:400 produced luminescence corresponding to 10 μg/μl (0.18 nM) of purified protein. Assuming an intracellular volume of approximately 1 μm$^3$, corresponding to an intracellular volume of 0.5% of the culture volume, the intracellular concentration of luciferase is expected to be approximately 14 μM (calculated as: 0.18 nM×400/0.5%). Concentrations for the strains harboring the other seven promoters was similarly calculated and plotted in FIG. 11c.

Tissue Preparation and microscopy. Harvested tissues were immediately transferred to a 4% paraformaldehyde solution in PBS for a 48 hour fixation. Samples were then embedded in O.C.T. Compound (Tissue-Tek) and sectioned to either 4 μm (FIG. 2c) or 100 μm thickness (FIG. 3d-f) on a Leica CM3050 S cryostat. 4 μm sections were fully dried; 100 μm sections were immediately processed without drying. All samples were stained for 45 minutes with 4',6-Diamidino-2-phenylindole dihydrochloride (DAPI; Sigma-Aldrich) and Alexa Fluor 594 Phalloidin (Life Technologies), and 100 μm sections were also stained with Fluorescein labeled *Ulex Europaeus* Agglutinin I (UEAI; Vector Laboratories), followed by a PBS wash and mounting in VECTASHIELD (Vector Laboratories). Images were taken on a Zeiss LSM 700 confocal microscope using lambda mode to obtain independent spectral profiles for each of the 488 nm, 555 nm and 639 nm lasers.

Image processing and transformation. Linear unmixing was applied to each spectral profile independently to separate the following channels: DAPI, GFP, UEAI, mCherry, and Phalloidin for FIG. 2c-e, and DAPI, GFP, mCherry and autofluorescent plant material for FIG. 2f. Linear deconvolution was applied (ImageJ plugin Diffraction PSF 3D by Bob Dougherty) to all channels except UEAI and plant material, and the default ImageJ despeckling plugin was applied. To generate the single cell expression profiles (FIG. 3b-c), the deconvolved DAPI image was thresholded, a mask was generated for lumen-side objects of approximately bacteria size (0.1 to 1 μm$^2$), and a watershed algorithm was applied to help separate contacting cells. Then the average GFP and mCherry value was determined for each object (single bacteria cell) and plotted with Matlab. To visually distinguish log-separated GFP values, thresholds were chosen based on the GFP/mCherry single-cell fluorescent profiles, to transform the following GFP/mCherry categories to unique colors: low/low=blue; medium/low=cyan; high/low=green; low/high=red: medium/high=orange; high/high=yellow. Additionally, to better visualize ambiguity in category calls, values within 1.75-fold and 6-fold of the GFP and RFP thresholds, respectively, are colored grey. Each pixel was independently transformed to the value determined by the GFP/mCherry category, multiplied by the DAPR value, and overlaid with the UEAI and Phalloidin channels (FIG. 2d-e) or plant material (FIG. 2f). Cells containing more than 25% pixels of another category or near threshold values (grey pixels) are considered to be ambiguous calls.

Example 2: Promoter Tests

Assays were performed to test the ability of various sequences to function as promoters in *Bacteroides* cells (see Table 6 and Table 7 for results).

TABLE 6

Promoter activity assay. Promoter "P6" refers to the phage promoter identified in Example 1 above, and SEQ ID NOs: 388-394 are various truncated versions of the promoter sequence of SEQ ID NO: 8. The underlined nucleotides are those that are added relative to the sequence of SEQ ID NO: 399. P5 is a different phage promoter sequence identified during the experiments described in Example 1 above.

| Promoter | Avg Activity | 95% CI | Length (nt) | Sequence | SEQ ID NO |
|---|---|---|---|---|---|
| blank cells | 1.0 | 0.1 | 0 | | |
| P6(−36, +1) | 1.1 | 0.0 | 37 | cacttgaactttcaaataatgttcttatatttgcagt | 399 |
| P6(−54, +1) | 6.2 | 1.3 | 55 | tgtttaaaatttaaagtttcacttgaactttcaaataatgttcttatatttgcagt | 389 |
| P6(−56, +1) | 4.7 | 0.4 | 57 | attgttaaaatttaaagtttcacttgaactttcaaataatgttcttatatttgcagt | 390 |
| P6(−46, +17) | 6.2 | 0.1 | 63 | tttaaagtttcacttgaactttcaaataatgttcttatatttgcagtgtcgaaagaaacaaag | 391 |
| P6(−56, +17) | 5.8 | 0.3 | 73 | attgttaaaatttaaagtttcacttgaactttcaaataatgttcttatatttgcagtgtcgaaagaaacaaag | 392 |
| P6(−74, +1) | 6.5 | 0.2 | 75 | gtttgcaatggttaatctattgttaaaatttaaagtttcacttgaactttcaaataatgttcttatatttgcagt | 393 |
| P6(−74, +17) | 16.6 | 1.2 | 91 | gtttgcaatggttaatctattgttaaaatttaaagtttcacttgaactttcaaataatgttcttatatttgcagtgtcgaaagaaacaaag | 388 |
| P6(−93, +20) | 8.8 | 0.2 | 114 | gactacctttttttgtttgtttgcaatggttaatctattgttaaaatttaaagtttcacttgaactttcaaataatgttcttatatttgcagtgtcgaaagaaacaaagtag | 394 |
| P5(−54, +1) | 4.3 | 0.1 | 55 | agttaatgcacgttaaagtatttgctactgagaaatatatccgtatatttgcagt | 405 |

TABLE 6-continued

Promoter activity assay. Promoter "P6" refers to the phage promoter identified in Example 1 above, and SEQ ID NOs: 388-394 are various truncated versions of the promoter sequence of SEQ ID NO: 8. The underlined nucleotides are those that are added relative to the sequence of SEQ ID NO: 399. P5 is a different phage promoter sequence identified during the experiments described in Example 1 above.

| Promoter | Avg Activity | 95% CI | Length (nt) | Sequence | SEQ ID NO |
|---|---|---|---|---|---|
| P5(-93, +20) | 8.7 | 0.3 | 114 | gagtaactacgataataaagtgataattcaatgttaaaaca gttaatgcacgttaaagtatttgctactgagaaatatatccgta tatttgcagcgtagaagttattactaacg | 406 |
| P5(-74, +17) | Not tested | | 91 | tgataattcaatgttaaaacagttaatgcacgttaaagtatttg ctactgagaaatatatccgtatatttgcagcgtagaagttatta cta | 407 |

TABLE 7

Promoter activity assay. Promoter "P6" refers to the phage promoter identified in Example 1, and SEQ ID NOs: 395-397 are various truncated versions of the promoter sequence of SEQ ID NO: 8. The underlined nucleotides are those that are added relative to the sequence of SEQ ID NO: 399 (see Table 6). Note: the results of Table 7 are not directly comparable to those of Table 6. Thus, direct comparisons can be made within each table, but not across tables.

| Promoter | Avg Activity | 95% CI | Length (nt) | Sequence | SEQ ID NO |
|---|---|---|---|---|---|
| blank cells | 1.0 | 0.0 | 0 | | |
| P6(-40, +20) | 3.4 | 1.0 | 60 | gtttcacttgaactttcaaataatgttcttatatttgcagtg tcgaaagaaacaaagtag | 395 |
| P6(-60, +20) | 20.8 | 4.7 | 80 | atctattgttaaaatttaaagtttcacttgaactttcaaat aatgttcttatatttgcagtgtcgaaagaaacaaagta g | 396 |
| P6(-80, +20) | 50.8 | 8.6 | 100 | tgttttgtttgcaatggttaatctattgttaaaatttaaagtt tcacttgaactttcaaataatgttcttatatttgcagtgtc gaaagaaacaaagtag | 397 |
| P6(-100, +20) | 57.8 | 2.6 | 120 | caattgggctacctttttttttgttttgtttgcaatggttatct attgttaaaatttaaagtttcacttgaactttcaaataat gttcttatatttgcagtgtcgaaagaaacaaagtag | 8 |

Example 3: Promoter Function in Multiple Different Cells

FIG. 20 demonstrates that a subject promoter that is operable in *Bacteroides* cells can also be operable in other types of prokaryotic cells (e.g., an *E. coli* cells). Thus, in some cases, a subject promoter, in addition to being operable in *Bacteroides* cells, is also operable in non-*Bacteroides* cells (e.g., prokaryotic cells such as *E. coli* cells). FIG. 20 depicts *E. coli* cells expressing a GFP transgene that is operably linked to the promoter of SEQ ID NO: 388 (which is demonstrated herein to be operable in *Bacteroides* cells, and also in *E. coli* cells).

Example 4: Cleavable Linkers Tested for Secreted Fusion Proteins

To develop a peptide secretion strategy, proteins were identified that function across the *Bacteroides* genus to secrete tethered peptides. Peptides tethered by linkers designed to be cleaved by gut proteases were cleanly released.

Results

Peptide Secretion Strategy

Figure 17C:
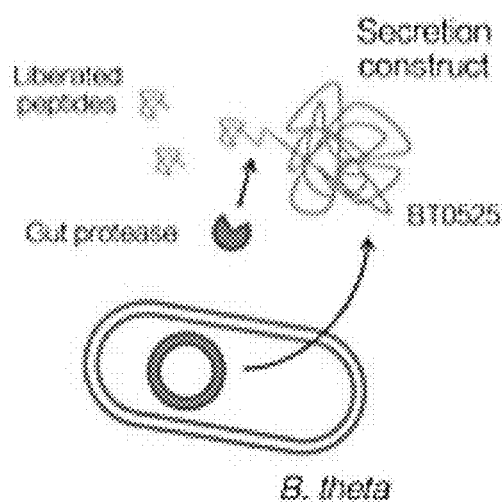
Figure 17D:
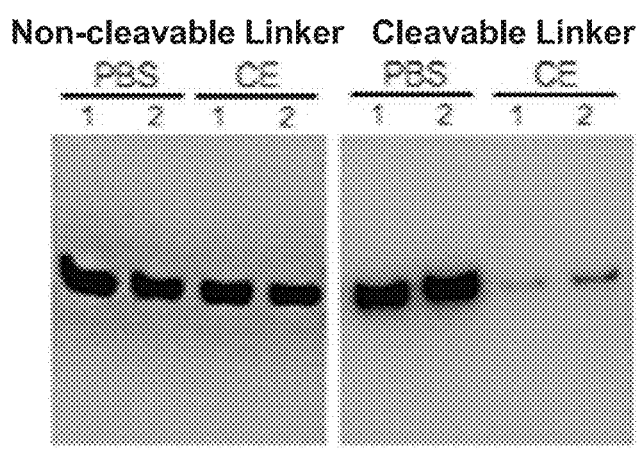

In addition to the high-throughput strain modification and strong, predictable protein expression methods developed here, it was desired to further expand the repertoire of tools available for engineering gut-resident prokaryotic species (e.g., *Bacteroides* species). Reliable means of heterologous protein secretion in gram-negative bacteria are lacking, and previously described signal sequence were unable to direct proteins of interest outside of cells. In order to take advantage of native protein secretion in the *Bacteroides*, a mass spectrometry-based proteomics assay was performed to determine natural secreted proteins from *B. thetaiotaomicron* (FIG. 17). Multiple candidate-secreted proteins were cloned under strong constitutive expression, using native RBSs, with a C-terminal triple FLAG tag and tested for soluble secretion into the media. Many proteins were identified to be secreted via outer membrane vesicle (OMVs), some having been identified in a recently published study on *Bacteroides* OMVs, and one candidate (product of hypothetical ORF BT_0525) was identified to be secreted as a soluble protein into the cell culture medium using a carefully designed Western blot technique to account for cell lysis when analyzing protein secretion. To develop BT0525 (SEQ ID NO: 459) as a generalizable tool for protein secretion in the *Bacteroides*, secretion of a protein from the six *Bacteroides* species used above (which, as described above, were used to test variations of $P_{BfP1E6}$) was attempted. The same strong, constitutively expressed and FLAG-tagged version of BT0525 that was used to confirm soluble secretion in *B. theta*, was chromosomally inserted into the other six species. Translatability of secretion of BT0525 into the culture supernatant across divergent members of the *Bacteroides* genus was demonstrated (FIG. 17b). Using this broadly applicable carrier protein, a system was designed to deliver peptide cargo from *Bacteroides* cells into the gut milieu. Because the gastrointestinal tract is rich with proteases, linkers were used to connect the peptide cargo to the carrier protein with motifs that could be targeted by common gut proteases (FIG. 17c). It was next experimentally demonstrated that *B. thetaiotaomicron* grown in vitro can secrete a 30 amino acid 6× His/3×FLAG tag (HHHHHH-GG-DYKDHDG-DYKDHDI-DYKDDDDK) (SEQ ID NO: 410) cargo peptide, and that the cargo was released upon treatment with extract from murine cecal contents (FIG. 17c). When the linker was mutated at the predicted amino acid cleavage site, the peptide cargo is no longer released upon treatment with cecal extract.

Figure 22:
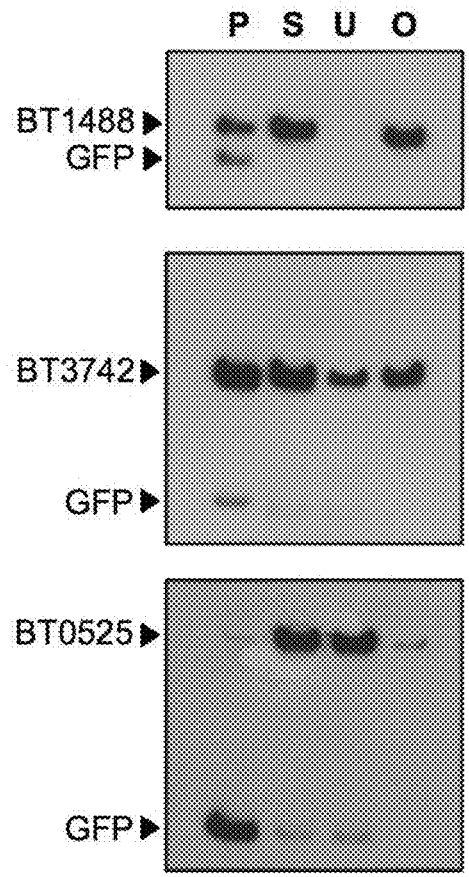
FIG. 22. Bt secretes proteins via OMVs. When secreted protein candidates were cloned under constitutive expression with a 3×FLAG tag and cell pellet (P), cell-free culture supernatant (S), ultracentrifuged S to remove OMVs (U), and recovered OMVs (O) were analyzed via western blot, protein products of BT1488 and BT3742 localized to OMVs (presence of BT3742 in the ultracentrifuged supernatant is accounted for by lysis) while BT0525 localized mainly to the cell-free supernatant.

FIG. 22. Bt secretes proteins via OMVs. When secreted protein candidates were cloned under constitutive expression with a 3×FLAG tag and cell pellet (P), cell-free culture supernatant (S), ultracentrifuged S to remove OMVs (U), and recovered OMVs (O) were analyzed via western blot, protein products of BT1488 and BT3742 localized to OMVs (presence of BT3742 in the ultracentrifuged supernatant is accounted for by lysis) while BT0525 localized mainly to the cell-free supernatant.

Figure 23:
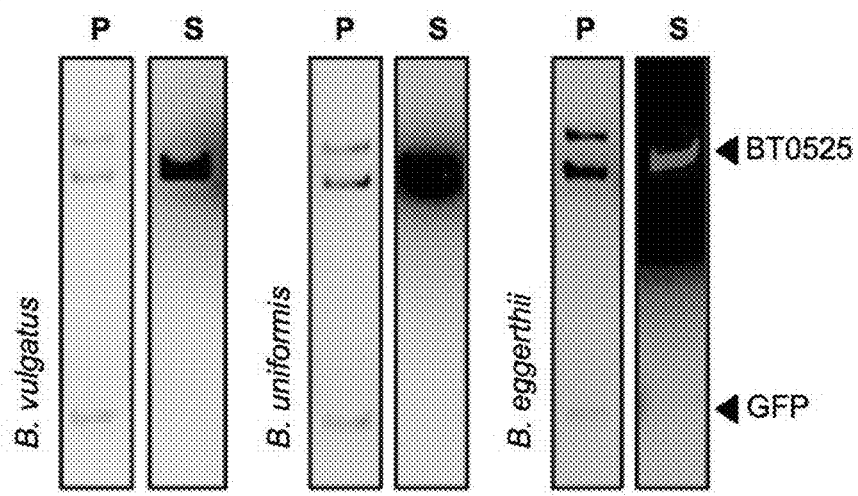
FIG. 23 Diverse species of *Bacteroides* secrete BT0525. Western blot analysis of By, Bu, and Be strains expressing sfGFP and BT0525, each under $P_{BfP1E6}$ and with a 3×FLAG tag. Cell pellets show expression of both proteins, while culture supernatants demonstrate secretion of BT0525 independent of lysis. These three species of *Bacteroides* are able to accumulate more BT0525 signal in the supernatant than Bt, Bf, or Bo for unknown reasons. This could be due to differential expression of secretion machinery, degradation machinery in the periplasm or at the cell membrane, or of proteases that are released extracellularly.
Figure 24A:
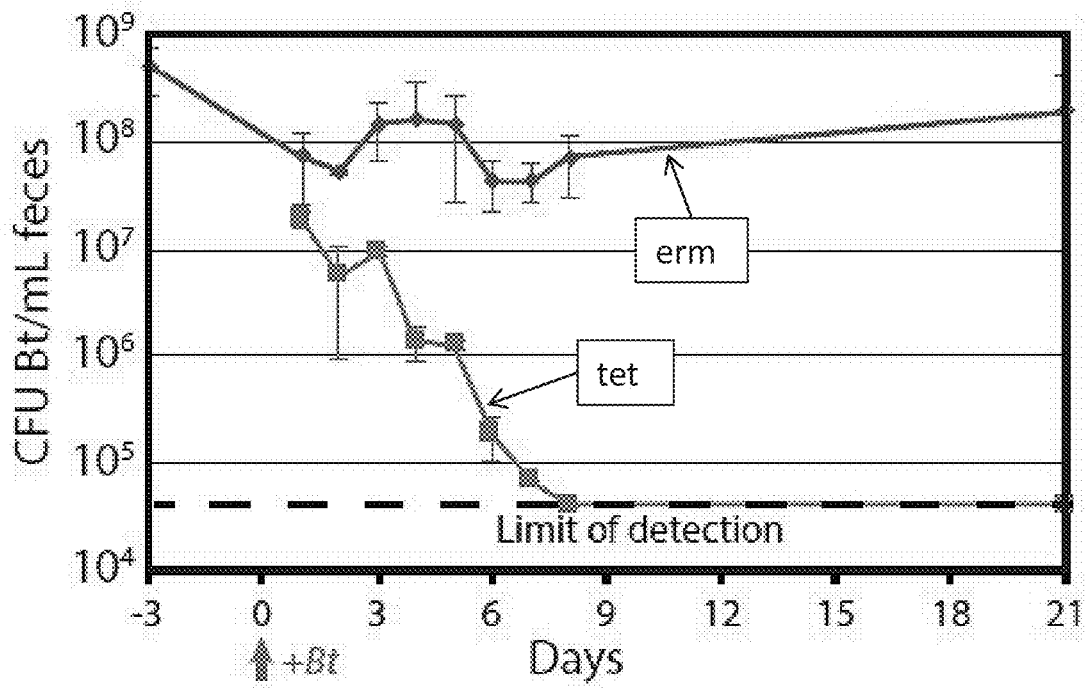
FIG. 24a-24f Colonization by Bt prevents crypt localization of an isogenic strain.
Figure 24B:
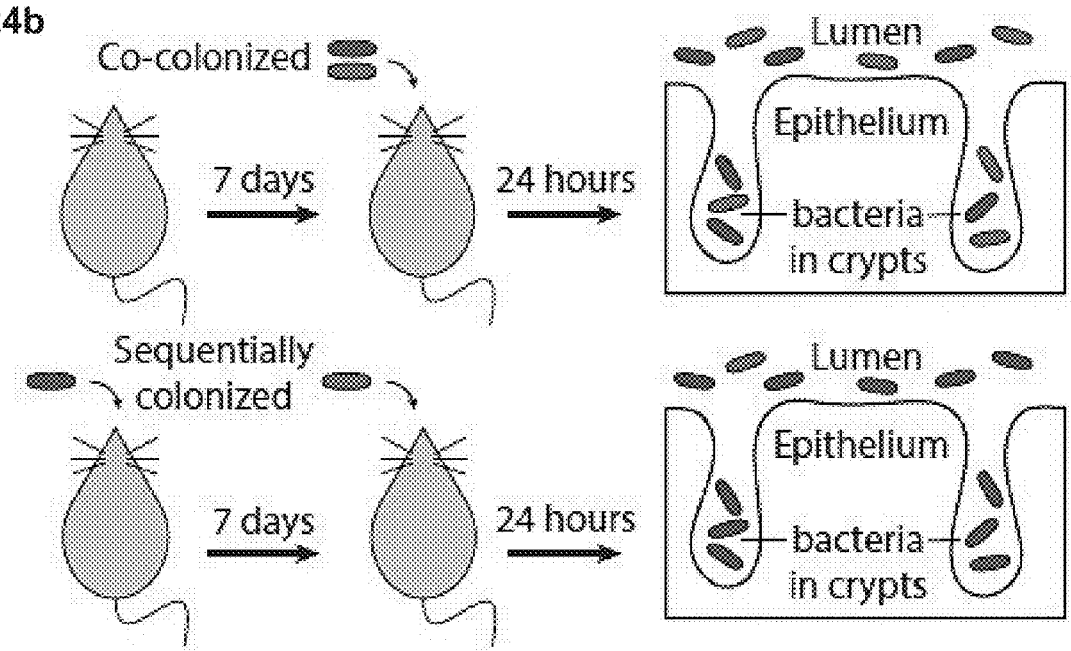
Figure 24C:
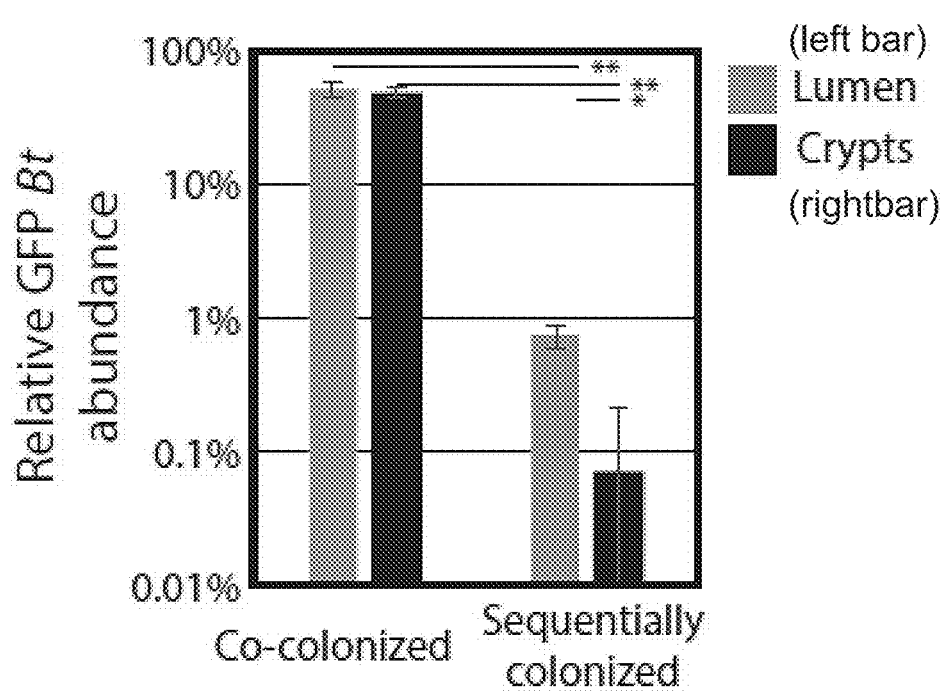
Figure 24D:
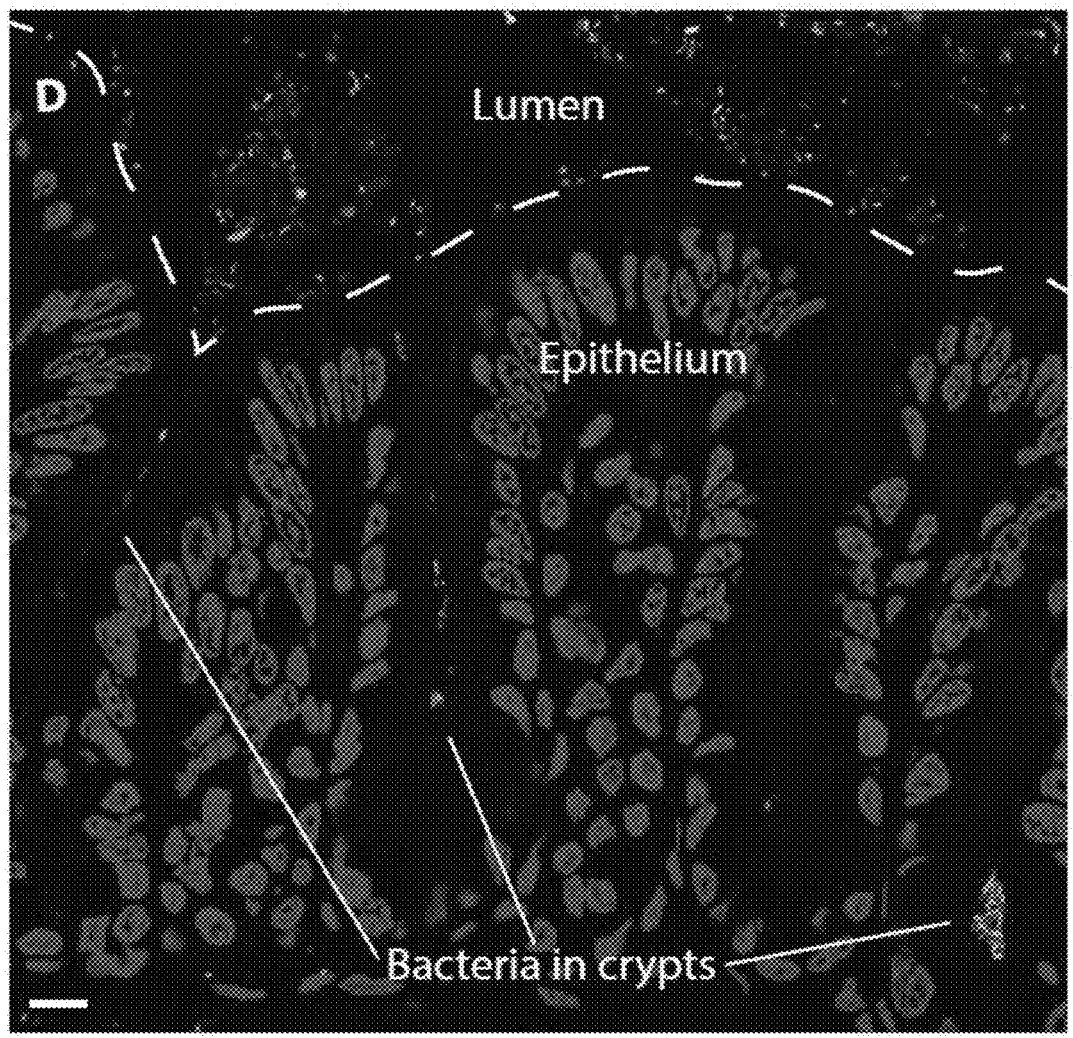
Figure 24E:
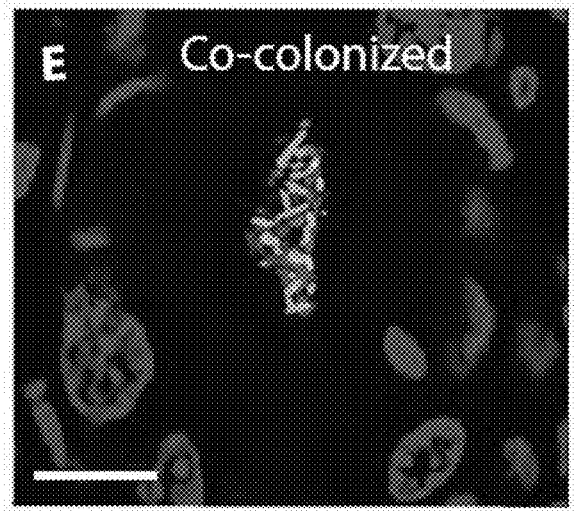
Figure 24F:
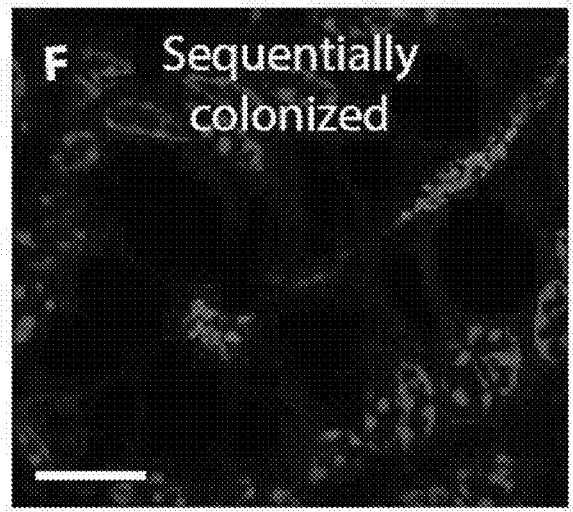

FIG. 23 Diverse species of *Bacteroides* secrete BT0525. Western blot analysis of By, Bu, and Be strains expressing sfGFP and BT0525, each under $P_{BfP1E6}$ and with a 3×FLAG tag. Cell pellets show expression of both proteins, while culture supernatants demonstrate secretion of BT0525 independent of lysis. These three species of *Bacteroides* are able to accumulate more BT0525 signal in the supernatant than Bt, Bf, or Bo for unknown reasons. This could be due to differential expression of secretion machinery, degradation machinery in the periplasm or at the cell membrane, or of proteases that are released extracellularly.

Materials and Methods

Secreted protein proteomics. Wild-type Bt was grown in 150 mL Salyer's Minimal Media+glucose in triplicate, anaerobically at 37° C. to mid-log. Cultures were centrifuged at 2700 g for 20 minutes to pellet the cells. Culture supernatant was then filter sterilized with a 0.2 μm filter (Corning), concentrated 300× with 10 k Centriprep centrifugal concentrator tubes (Millipore), and buffer exchanged into 50 mM Tris at a pH of 8. A 1 mL aliquot of cell pellet was resuspended in 1 mL urea lysis buffer+protease inhibitor (Roche). Cell pellet and culture supernatant were each run on an SDS-PAGE gel and stained with Coomassie to visualize protein banding patterns in each fraction. The same samples were then analyzed by GC-MS [more info here on how Josh did this and analyzed the data?] and reads were mapped back to the Bt protein database and identified by predicted ORF. The average reads in the cell pellet and culture supernatant for individual proteins found in two of the three replicates were plotted with standard deviation to visualize representation in each cell fraction.

Western blot analysis of secreted proteins. To differentiate between protein in the cell culture supernatant due to active secretion as compared to cell lysis, a control Bt strain expressing genomically integrated 3×FLAG-tagged superfolder GFP (which folds too efficiently to be secreted, allowing GFP signal in the supernatant to act as a proxy for cell lysis) was developed. Candidate proteins of interest were then cloned under PBfP1E6 and their native RBS with a C-terminal 3×FLAG tag, and genomically integrated into the lysis control strain. For testing secretion of BT0525 in diverse *Bacteroides* species, the GFP lysis control plasmid was subcloned into the BT0525 expression plasmid via BamHI/XbaI and BglII/SpeI sites and the resulting construct was genomically integrated into Bt, Bf, Bv, Bu, Bo, and Be, as Be appeared unable to accept two separate plasmids. All strains tested for protein secretion were grown to mid-log in either Salyer's Minimal Media+glucose or in TYG. Cultures were centrifuged at 8000 g in a tabletop centrifuge for 10 minutes, culture supernatant was harvested, and cell pellet was resuspended in PBS at the original volume. To test for secretion via OMVs, culture supernatants were filter sterilized with a 0.2 μm filter (Corning), 44 mL were centrifuged in a 70Ti rotor in a Beckman Coulter Optima L-90K ultracentrifuge at 37 k rpm and 4° C. for 2 hours, washed in PBS, and OMV pellets were resuspended in 1 mL PBS. Cell pellet fractions were diluted 1:20 in PBS to achieve linear-range visualization on the western blot, and run with undiluted supernatant samples on SDS-PAGE gels. Samples were blotted onto nitrocellulose membranes using the iBlot dry transfer system (Life Technologies), and stained with an anti-FLAG HRP-conjugated antibody (Sigma).

Peptide release via cleavable linkers. Strains of Bt expressing BT0525 linked to a 6×His-3×FLAG tag via designed linkers were grown overnight in TYG. Cultures were centrifuged at 8000 g for 10 minutes, and supernatant was harvested. Supernatant was exposed to either PBS or increasing concentrations of cecal extract (liquid fraction of centrifuged murine cecal contents from conventional mice) for 10 minutes at 37° C. Digestion was immediately stopped by addition of reducing SDS-PAGE sample buffer and heat treatment at 70° C. for 10 minutes. Samples were analyzed via western blotting as described above.

Table 11 provides data from testing a number of cleavable linkers positioned between a polypeptide of interest and a secreted *Bacteroides* protein (BT0525) (SEQ ID NO: 459). A nucleotide sequence of interest encoding the fusion protein (the secreted *Bacteroides* protein fused to the polypeptide of interest) was place under the control of a subject promoter (operable in *Bacteroides* cells) and the nucleic acid was integrated in the genome of a *Bacteroides* cell. The secreted fusion protein was then collected and assayed to determine whether the linker was cleaved.

TABLE 11

The cleavable linkers of Table 10 were tested for their ability to function.

| Linkers: | Amino acid sequence (cleavage at bold amino acid) | Target peptidase | Secretion detected | Cleavage observed by gut contents? | SEQ ID NO |
|---|---|---|---|---|---|
| CL0 | GSGSSGGS | Control (no cleavage expected) | High | No | 420 |
| CL1 | SGPTGHGR | Trypsin | Moderate | Yes | 422 |
| CL2 | SGPTGMAR | Trypsin | Weak | Yes | 423 |
| CL3 | SGPTASPL | Chymotrypsin | High | Yes | 424 |
| CL4 | SGPTTAPF | Chymotrypsin B | High | Yes | 425 |
| CL5 | SGPTAAPA | Elastase 1 | High | Yes | 426 |
| CL4x | SGPTTAPG | Control (no cleavage expected) | High | No | 421 |

Example 5: Polypeptides of Interest are Assayed for their Ability to Treat Colitis in Mice The data presented herein show that combining these tools, two anti-inflammatory peptides were successfully delivered to mice with colitis, and these delivered peptides successfully treated murine colitis.

Results

Figure 18A:
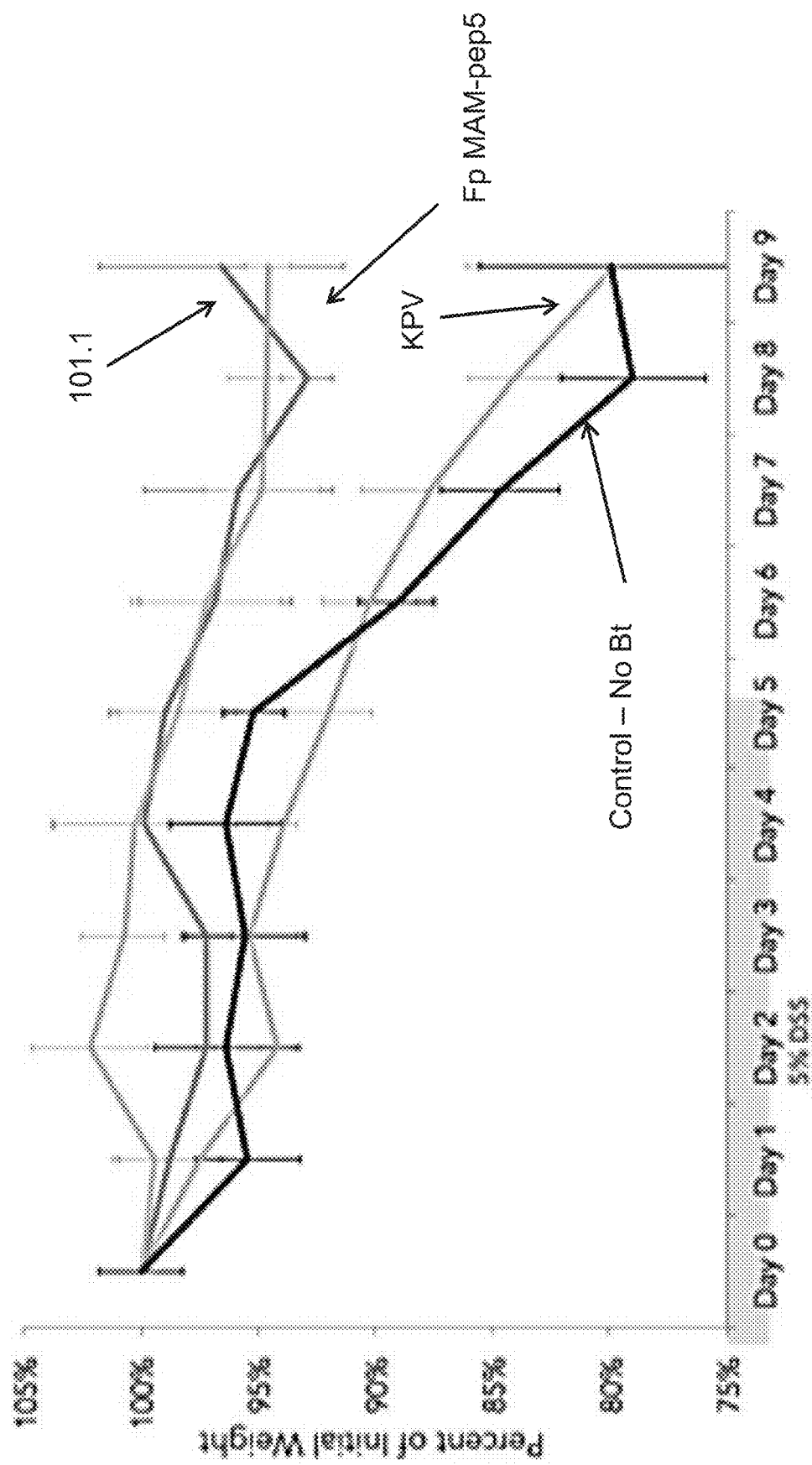
FIG. 18a-18b. *B. thetaiotaomicron* secreting anti-inflammatory peptides protect mice from DSS-induced colitis.
Figure 18B:
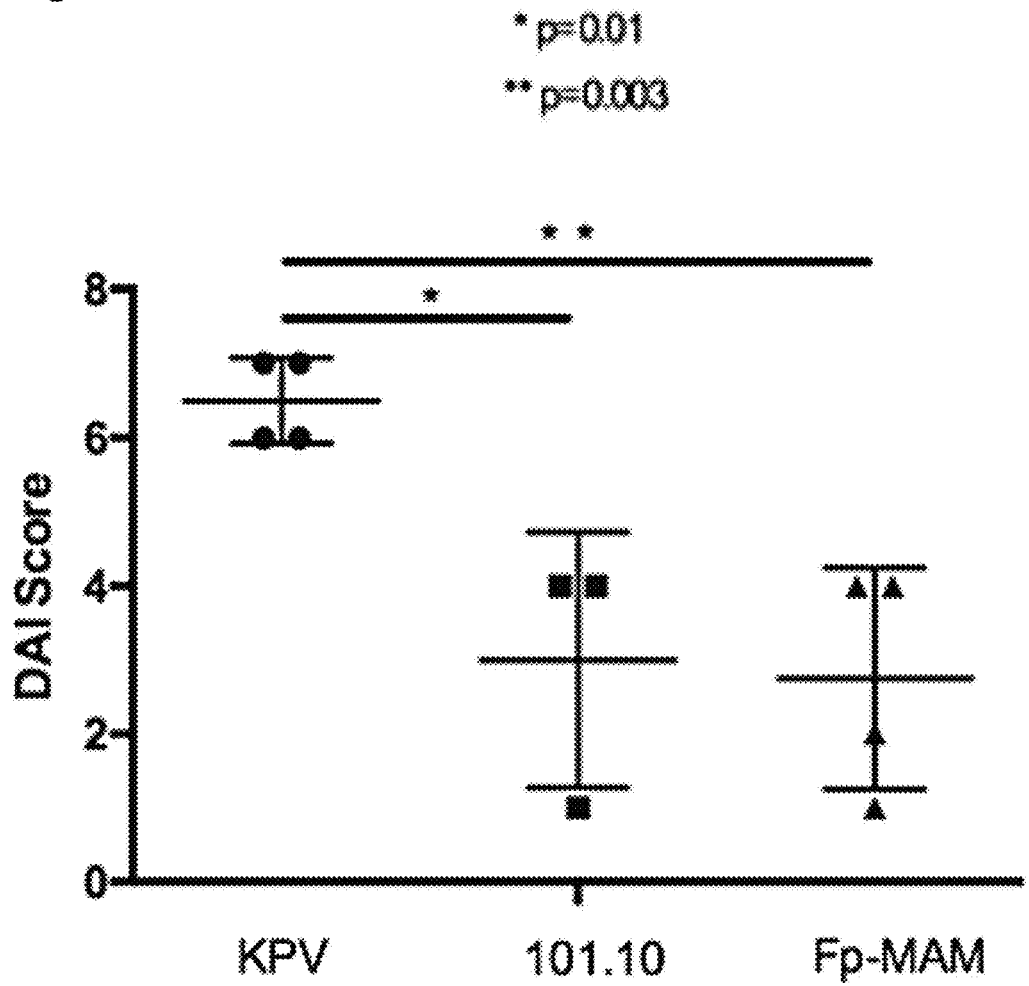

To test the efficacy of this peptide delivery system in vivo, the ability of Bt secreting BT0525 linked to anti-inflammatory peptides to offset the effects of DSS-induced colitis in mice was examined. Male germ free mice were colonized with a model community of three representative organisms: *Clostridium scindens, Edwardsiella tarda*, and *Bacteroides vulgatus*. After allowing two weeks for community equilibration, the mice were switched to 5% DSS in the drinking water to induce colitis. Simultaneously, Bt secreting one of three anti-inflammatory peptides (AIP)—FpMAM-pep5 (SEQ ID NO: 412), 101.10 (SEQ ID NO: 411), or KPV (SEQ ID NO: 415)—via cleavable linkage to BT0525 expressed with PBfP1E6 was administered. Weight of the mice was monitored for nine days, and Disease Activity Index (DAI) was measured at sacrifice on day nine. Mice receiving either FpMAM-pep5 or 101.10 lost significantly less weight than mice that did not receive treatment (FIG. 18a), and demonstrated significantly lower DAI scores than mice that received KPV (FIG. 18b). This was similarly repeated for FpMAM-pep5 delivery in conventional mice via daily oral gavage, and also exhibited a significant alleviation of DSS-induced weight loss. This demonstrates the collection of tools developed here function in the gut, delivering enough anti-inflammatory peptides to significantly impact host physiology.

Materials and Methods

Mouse colitis treatment experiment. Male, Germ-free Swiss Webster mice (Taconic) were orally gavaged with an equal mixture of *Edwardsiella tarda, Clostridium scindens*, and *Bacteroides vulgatus* from overnight culture. After two weeks of community equilibration, mice were switched to 5% Dextran Sodium Sulfate (Affymetrix) in the drinking water. They were simultaneously orally gavaged with ~10 CFU of a 1:1:1 mix of Bt expressing an anti-inflammatory peptide linked to BT0525 via cleavable linkers 1, 3, and 4 (SUPP), and were grouped as follows: FpMAM-pep5 (n=4), 101.10 (n=3), or KPV (n=4). Mice were weighed each day for nine days, and sacrificed on day nine. At sacrifice, stool consistency, blood in the stool (Hemoccult SENSA, Beckman Coulter), and final weight were measured to calculate the Disease Activity Index. The same experiment was performed using 5 female mice that received no treatment, as a baseline measurement of response of weight to DSS.

Table 12 provides data from testing whether various therapeutic peptides could be used as polypeptides of interest to treat colitis in mice. The indicated peptide was fused to a secreted *Bacteroides* protein (BT0525) (SEQ ID NO: 459) with a cleavage linker (cleavable by gut proteases) positioned between them. A nucleotide sequence of interest encoding the fusion protein (the secreted *Bacteroides* protein fused to the indicated peptide) was place under the control of a subject promoter (operable in *Bacteroides* cells) and the nucleic acid was integrated into the genome of *Bacteroides* cells. The *Bacteroides* cells were then introduced into the guts of mice. The mice were injected with DSS (a mouse model of colitis) and the effect of the introduced bacteria (secreted the fusion protein) on colitis was assayed.

TABLE 12

The peptides of Table 12 were tested for their ability to impact DSS-induced colitis in mice.

| Peptide | SEQ ID NO | Type | Significant effect in mice |
|---|---|---|---|
| 101.10 | 411 | IL-1 inhibitory peptides | Yes—reduced disease |
| Fp MAM-pep5 | 412 | anti-NF-κB | Yes—reduced disease |
| CD80-CAP1 | 413 | CD80 antagonistoc peptide | *Yes—negative impact, likely due to too high a dose |
| Pep2305 | 414 | IL-23 inhibitory peptides | No |
| KPV | 415 | NF-kB and MAPK inhibition | No |

TABLE 12-continued

The peptides of Table 12 were tested for
their ability to impact DSS-induced colitis in mice.

| Peptide | SEQ ID NO | Type | Significant effect in mice |
|---------|-----------|------|----------------------------|
| WP9QY | 416 | anti-TNF | No |
| P144 | 417 | TGF-b inhibitory peptide | No |

*Various different reduced doses can be now be routinely and systematically tested, e.g., using the promoters presented herein that have a wide variety of strengths.

The preceding merely illustrates the principles of the invention. It will be appreciated that those skilled in the art will be able to devise various arrangements which, although not explicitly described or shown herein, embody the principles of the invention and are included within its spirit and scope. Furthermore, all examples and conditional language recited herein are principally intended to aid the reader in understanding the principles of the invention and the concepts contributed by the inventors to furthering the art, and are to be construed as being without limitation to such specifically recited examples and conditions. Moreover, all statements herein reciting principles, aspects, and embodiments of the invention as well as specific examples thereof, are intended to encompass both structural and functional equivalents thereof. Additionally, it is intended that such equivalents include both currently known equivalents and equivalents developed in the future, i.e., any elements developed that perform the same function, regardless of structure. The scope of the present invention, therefore, is not intended to be limited to the exemplary embodiments shown and described herein. Rather, the scope and spirit of the present invention is embodied by the appended claims.

SEQUENCE LISTING (512 sequences)

SEQ ID NO: 1 - DNA, 120 bp, Artificial sequence
  Synthetic sequence
caattgggctaccttttttttgtaaaaaaaaaccccgcccctgacagggcggggttttttttttcacttgaactttcaaataatgttcttataaaaccagtgtcgaaagaaacaaagtag

SEQ ID NO: 2 - DNA, 120 bp, Artificial sequence
  Synthetic sequence
caattgggctaccttttttttgtaaaaaaaaaccccgcccctgacagggcggggttttttttttcacttgaactttcaaataatgttcttatatatgcagtgtcgaaagaaacaaagtag

SEQ ID NO: 3 - DNA, 120 bp, Artificial sequence
  Synthetic sequence
caattgggctaccttttttttgttttgtttgcaatggttaatctattgttaaaatttaaagtttcacttgaactttcaaataatgttcttatatgtgcagtgtcgaaagaaacaaagtag

SEQ ID NO: 4 - DNA, 120 bp, Artificial sequence
  Synthetic sequence
caattgggctaccttttttttgttttgtttgcaatggttaatctattgttaacatttaaagtttcacttgaactttcaaataatgttcttatattttcagtgtcgaaagaaacaaagtag

SEQ ID NO: 5 - DNA, 120 bp, Artificial sequence
  Synthetic sequence
caattgggctaccttttttttgttttgtttgcaatggttaatctattgttaaaatttaaagtttcacttgaactttcaaataatgttcttctatttgcagtgtcgaaagaaacaaagtag

SEQ ID NO: 6 - DNA, 120 bp, Artificial sequence
  Synthetic sequence
caattgggctaccttttttttgttttgtttgcaatggttaatctattgttaaaatttaaagtttcacttgaactttcaaataatgttcttatatttccagtgtcgaaagaaacaaagtag

SEQ ID NO: 7 - DNA, 120 bp, Artificial sequence
  Synthetic sequence
caattgggctaccttttttttgttttgtttgcaatggttaatctattgttgaaatttaaagtttcacttgaactttcaaataatgttcttatatttgcagtgtcgaaagaaacaaagtag

SEQ ID NO: 8 - DNA, 120 bp, Artificial Sequence
  synthetic sequence
caattgggctaccttttttttgttttgtttgcaatggttaatctattgttaaaatttaaagtttcacttgaactttcaaataatgttcttatatttgcagtgtcgaaagaaacaaagtag

SEQ ID NO: 9 - DNA, 17 bp, Artificial sequence
  Synthetic sequence
aaaaaaaaaaaaaaaaa

SEQ ID NO: 10 - DNA, 36 bp, Artificial sequence
  Synthetic sequence
gactgatctatggattcaaaaaaatttaaaataatg

SEQ ID NO: 11 - DNA, 36 bp, Artificial sequence
  Synthetic sequence
gactgatcggcgcgactcacgcgccgatcagtaatg

SEQ ID NO: 12 - DNA, 36 bp, Artificial sequence
  Synthetic sequence
gactgatcgggaggagtaaaaaatattaaaataatg

SEQ ID NO: 13 - DNA, 36 bp, Artificial sequence
  Synthetic sequence
gactgatctctggggtgaataaaatttataataatg

SEQ ID NO: 14 - DNA, 36 bp, Artificial sequence
  Synthetic sequence
gactgatcccccattctattaaattttagaataatg

SEQ ID NO: 15 - DNA, 36 bp, Artificial sequence
  Synthetic sequence
gactgatcggtgttagctttaaatattagaataatg

SEQ ID NO: 16 - DNA, 36 bp, Artificial sequence
  Synthetic sequence
gactgatctagcactcttaaaaaaattaaaataatg

SEQ ID NO: 17 - DNA, 36 bp, Artificial sequence
  Synthetic sequence
gactgatcgtaatctttaaaaaaaataaaaataatg

SEQ ID NO: 18 - DNA, 36 bp, Artificial sequence
  Synthetic sequence
gactgatcgtccatcaatttaaaatttaaaataatg

SEQ ID NO: 19 - DNA, 17 bp, Artificial sequence
  Synthetic sequence
aaaaaaaaaaaaaaaaa

SEQ ID NO: 20 - DNA, 156 bp, Artificial sequence
  Synthetic sequence
caattgggctaccttttttttgtaaaaaaaaaccccgcccctgacagggcggggttttttttttcacttgaactttcaaataatgttcttataaaaccagtgtcgaaagaaacaaagtaggactgatcggcgcgactcacgcgccgatcagtaatg

SEQ ID NO: 21 - DNA, 156 bp, Artificial sequence
  Synthetic sequence
caattgggctaccttttttttgtaaaaaaaaaccccgcccctgacagggcggggttttttttttcacttgaactttcaaataatgttcttataaaaccagtgtcgaaagaaacaaagtaggactgatcgggaggagtaaaaaatattaaaataatg

SEQ ID NO: 22 - DNA, 156 bp, Artificial sequence
  Synthetic sequence
caattgggctaccttttttttgtaaaaaaaaaccccgcccctgacagggcggggttttttttttcacttgaactttcaaataatgttcttataaaaccagtgtcgaaagaaacaaagtaggactgatctctggggtgaataaaatttataataatg

SEQ ID NO: 23 - DNA, 156 bp, Artificial sequence
  Synthetic sequence
caattgggctaccttttttttgtaaaaaaaaaccccgcccctgacagggcggggttttttttttcacttgaactttcaaataatgttcttataaaaccagtgtcgaaagaaacaaagtaggactgatcccccattctattaaattttagaataatg

SEQ ID NO: 24 - DNA, 156 bp, Artificial sequence
  Synthetic sequence
caattgggctaccttttttttgtaaaaaaaaaccccgcccctgacagggcggggttttttttttcacttgaactttcaaataatgttcttataaaaccagtgtcgaaagaaacaaagtaggactgatcggtgttagctttaaatattagaataatg

SEQ ID NO: 25 - DNA, 156 bp, Artificial sequence
  Synthetic sequence
caattgggctaccttttttttgtaaaaaaaaaccccgcccctgacagggcggggttttttttttcacttgaactttcaaataatgttcttataaaaccagtgtcgaaagaaacaaagtaggactgatctagcactcttaaaaaaattaaaataatg

SEQ ID NO: 26 - DNA, 156 bp, Artificial sequence
  Synthetic sequence
caattgggctaccttttttttgtaaaaaaaaaccccgcccctgacagggcggggttttttttttcacttgaactttcaaataatgttcttataaaaccagtgtcgaaagaaacaaagtaggactgatcgtaatctttaaaaaaaataaaaataatg

SEQ ID NO: 27 - DNA, 156 bp, Artificial sequence
  Synthetic sequence
caattgggctaccttttttttgtaaaaaaaaaccccgcccctgacagggcggggttttttttttcacttgaactttcaaataatgttcttataaaaccagtgtcgaaagaaacaaagtaggactgatcgtccatcaatttaaaatttaaaataatg

SEQ ID NO: 28 - DNA, 156 bp, Artificial sequence
  Synthetic sequence
caattgggctaccttttttttgtaaaaaaaaaccccgcccctgacagggcggggttttttttttcacttgaactttcaaataatgttcttatatatgcagtgtcgaaagaaacaaagtaggactgatcggcgcgactcacgcgccgatcagtaatg

SEQ ID NO: 29 - DNA, 156 bp, Artificial sequence
  Synthetic sequence
caattgggctaccttttttttgtaaaaaaaaaccccgcccctgacagggcggggttttttttttcacttgaactttcaaataatgttcttatatatgcagtgtcgaaagaaacaaagtaggactgatcgggaggagtaaaaaatattaaaataatg

SEQ ID NO: 30 - DNA, 156 bp, Artificial sequence
  Synthetic sequence
caattgggctaccttttttttgtaaaaaaaaaccccgcccctgacagggcggggttttttttttcacttgaactttcaaataatgttcttatatatgcagtgtcgaaagaaacaaagtaggactgatctctggggtgaataaaatttataataatg

SEQ ID NO: 31 - DNA, 156 bp, Artificial sequence
  Synthetic sequence
caattgggctaccttttttttgtaaaaaaaaaccccgcccctgacagggcggggttttttttttcacttgaactttcaaataatgttcttatatatgcagtgtcgaaagaaacaaagtaggactgatcccccattctattaaattttagaataatg

SEQ ID NO: 32 - DNA, 156 bp, Artificial sequence
  Synthetic sequence
caattgggctaccttttttttgtaaaaaaaaaccccgcccctgacagggcggggttttttttttcacttgaactttcaaataatgttcttatatatgcagtgtcgaaagaaacaaagtaggactgatcggtgttagctttaaatattagaataatg

SEQ ID NO: 33 - DNA, 156 bp, Artificial sequence
  Synthetic sequence
caattgggctaccttttttttgtaaaaaaaaaccccgcccctgacagggcggggttttttttttcacttgaactttcaaataatgttcttatatatgcagtgtcgaaagaaacaaagtaggactgatctagcactcttaaaaaaattaaaataatg

SEQ ID NO: 34 - DNA, 156 bp, Artificial sequence
  Synthetic sequence
caattgggctaccttttttttgtaaaaaaaaaccccgcccctgacagggcggggttttttttttcacttgaactttcaaataatgttcttatatatgcagtgtcgaaagaaacaaagtaggactgatcgtaatctttaaaaaaaataaaaataatg

SEQ ID NO: 35 - DNA, 156 bp, Artificial sequence
  Synthetic sequence
caattgggctaccttttttttgtaaaaaaaaaccccgcccctgacagggcggggttttttttttcacttgaactttcaaataatgttcttatatatgcagtgtcgaaagaaacaaagtaggactgatcgtccatcaatttaaaatttaaaataatg

SEQ ID NO: 36 - DNA, 156 bp, Artificial sequence
  Synthetic sequence
caattgggctaccttttttttgttttgtttgcaatggttaatctattgttaaaatttaaagtttcacttgaactttcaaataatgttcttatatgtgcagtgtcgaaagaaacaaagtaggactgatcggcgcgactcacgcgccgatcagtaatg

SEQ ID NO: 37 - DNA, 156 bp, Artificial sequence
  Synthetic sequence
caattgggctaccttttttttgttttgtttgcaatggttaatctattgttaaaatttaaagtttcacttgaactttcaaataatgttcttatatgtgcagtgtcgaaagaaacaaagtaggactgatcgggaggagtaaaaaatattaaaataatg

SEQ ID NO: 38 - DNA, 156 bp, Artificial sequence
  Synthetic sequence
caattgggctaccttttttttgttttgtttgcaatggttaatctattgttaaaatttaaagtttcacttgaactttcaaataatgttcttatatgtgcagtgtcgaaagaaacaaagtaggactgatctctggggtgaataaaatttataataatg

SEQ ID NO: 39 - DNA, 156 bp, Artificial sequence
  Synthetic sequence
caattgggctaccttttttttgttttgtttgcaatggttaatctattgttaaaatttaaagtttcacttgaactttcaaataatgttcttatatgtgcagtgtcgaaagaaacaaagtaggactgatcccccattctattaaattttagaataatg

SEQ ID NO: 40 - DNA, 156 bp, Artificial sequence
  Synthetic sequence
caattgggctaccttttttttgttttgtttgcaatggttaatctattgttaaaatttaaagtttcacttgaactttcaaataatgttcttatatgtgcagtgtcgaaagaaacaaagtaggactgatcggtgttagctttaaatattagaataatg

SEQ ID NO: 41 - DNA, 156 bp, Artificial sequence
  Synthetic sequence
caattgggctaccttttttttgttttgtttgcaatggttaatctattgttaaaatttaaagtttcacttgaactttcaaataatgttcttatatgtgcagtgtcgaaagaaacaaagtaggactgatctagcactcttaaaaaaattaaaataatg

SEQ ID NO: 42 - DNA, 156 bp, Artificial sequence
  Synthetic sequence
caattgggctaccttttttttgttttgtttgcaatggttaatctattgttaaaatttaaagtttcacttgaactttcaaataatgttcttatatgtgcagtgtcgaaagaaacaaagtaggactgatcgtaatctttaaaaaaaataaaaataatg

SEQ ID NO: 43 - DNA, 156 bp, Artificial sequence
  Synthetic sequence
caattgggctaccttttttttgttttgtttgcaatggttaatctattgttaaaatttaaagtttcacttgaactttcaaataatgttcttatatgtgcagtgtcgaaagaaacaaagtaggactgatcgtccatcaatttaaaatttaaaataatg

SEQ ID NO: 44 - DNA, 156 bp, Artificial sequence
  Synthetic sequence
caattgggctaccttttttttgttttgtttgcaatggttaatctattgttaacatttaaagtttcacttgaactttcaaataatgttcttatattttcagtgtcgaaagaaacaaagtaggactgatcggcgcgactcacgcgccgatcagtaatg

SEQ ID NO: 45 - DNA, 156 bp, Artificial sequence
  Synthetic sequence
caattgggctaccttttttttgttttgtttgcaatggttaatctattgttaacatttaaagtttcacttgaactttcaaataatgttcttatattttcagtgtcgaaagaaacaaagtaggactgatcgggaggagtaaaaaatattaaaataatg

SEQ ID NO: 46 - DNA, 156 bp, Artificial sequence
  Synthetic sequence
caattgggctaccttttttttgttttgtttgcaatggttaatctattgttaacatttaaagtttcacttgaactttcaaataatgttcttatattttcagtgtcgaaagaaacaaagtaggactgatctctggggtgaataaaatttataataatg

SEQ ID NO: 47 - DNA, 156 bp, Artificial sequence
  Synthetic sequence
caattgggctaccttttttttgttttgtttgcaatggttaatctattgttaacatttaaagtttcacttgaactttcaaataatgttcttatattttcagtgtcgaaagaaacaaagtaggactgatcccccattctattaaattttagaataatg

SEQ ID NO: 48 - DNA, 156 bp, Artificial sequence
  Synthetic sequence
caattgggctaccttttttttgttttgtttgcaatggttaatctattgttaacatttaaagtttcacttgaactttcaaataatgttcttatattttcagtgtcgaaagaaacaaagtaggactgatcggtgttagctttaaatattagaataatg

SEQ ID NO: 49 - DNA, 156 bp, Artificial sequence
  Synthetic sequence
caattgggctaccttttttttgttttgtttgcaatggttaatctattgttaacatttaaagtttcacttgaactttcaaataatgttcttatattttcagtgtcgaaagaaacaaagtaggactgatctagcactcttaaaaaaattaaaataatg

SEQ ID NO: 50 - DNA, 156 bp, Artificial sequence
  Synthetic sequence
caattgggctaccttttttttgttttgtttgcaatggttaatctattgttaacatttaaagtttcacttgaactttcaaataatgttcttatattttcagtgtcgaaagaaacaaagtaggactgatcgtaatctttaaaaaaaataaaaataatg

SEQ ID NO: 51 - DNA, 156 bp, Artificial sequence
  Synthetic sequence
caattgggctaccttttttttgttttgtttgcaatggttaatctattgttaacatttaaagtttcacttgaactttcaaataatgttcttatattttcagtgtcgaaagaaacaaagtaggactgatcgtccatcaatttaaaatttaaaataatg

SEQ ID NO: 52 - DNA, 156 bp, Artificial sequence
  Synthetic sequence
caattgggctaccttttttttgttttgtttgcaatggttaatctattgttaaaatttaaagtttcacttgaactttcaaataatgttcttctatttgcagtgtcgaaagaaacaaagtaggactgatcggcgcgactcacgcgccgatcagtaatg

SEQ ID NO: 53 - DNA, 156 bp, Artificial sequence
  Synthetic sequence
caattgggctaccttttttttgttttgtttgcaatggttaatctattgttaaaatttaaagtttcacttgaactttcaaataatgttcttctatttgcagtgtcgaaagaaacaaagtaggactgatcgggaggagtaaaaaatattaaaataatg

SEQ ID NO: 54 - DNA, 156 bp, Artificial sequence
  Synthetic sequence
caattgggctaccttttttttgttttgtttgcaatggttaatctattgttaaaatttaaagtttcacttgaactttcaaataatgttcttctatttgcagtgtcgaaagaaacaaagtaggactgatctctggggtgaataaaatttataataatg

SEQ ID NO: 55 - DNA, 156 bp, Artificial sequence
  Synthetic sequence
caattgggctaccttttttttgttttgtttgcaatggttaatctattgttaaaatttaaagtttcacttgaactttcaaataatgttcttctatttgcagtgtcgaaagaaacaaagtaggactgatcccccattctattaaattttagaataatg

SEQ ID NO: 56 - DNA, 156 bp, Artificial sequence
  Synthetic sequence
caattgggctaccttttttttgttttgtttgcaatggttaatctattgttaaaatttaaagtttcacttgaactttcaaataatgttcttctatttgcagtgtcgaaagaaacaaagtaggactgatcggtgttagctttaaatattagaataatg

SEQ ID NO: 57 - DNA, 156 bp, Artificial sequence
  Synthetic sequence
caattgggctaccttttttttgttttgtttgcaatggttaatctattgttaaaatttaaagtttcacttgaactttcaaataatgttcttctatttgcagtgtcgaaagaaacaaagtaggactgatctagcactcttaaaaaaattaaaataatg

SEQ ID NO: 58 - DNA, 156 bp, Artificial sequence
  Synthetic sequence
caattgggctaccttttttttgttttgtttgcaatggttaatctattgttaaaatttaaagtttcacttgaactttcaaataatgttcttctatttgcagtgtcgaaagaaacaaagtaggactgatcgtaatctttaaaaaaaataaaaataatg

SEQ ID NO: 59 - DNA, 156 bp, Artificial sequence
  Synthetic sequence
caattgggctaccttttttttgttttgtttgcaatggttaatctattgttaaaatttaaagtttcacttgaactttcaaataatgttcttctatttgcagtgtcgaaagaaacaaagtaggactgatcgtccatcaatttaaaatttaaaataatg

SEQ ID NO: 60 - DNA, 156 bp, Artificial sequence
  Synthetic sequence
caattgggctaccttttttttgttttgtttgcaatggttaatctattgttaaaatttaaagtttcacttgaactttcaaataatgttcttatatttccagtgtcgaaagaaacaaagtaggactgatcggcgcgactcacgcgccgatcagtaatg

SEQ ID NO: 61 - DNA, 156 bp, Artificial sequence
  Synthetic sequence
caattgggctaccttttttttgttttgtttgcaatggttaatctattgttaaaatttaaagtttcacttgaactttcaaataatgttcttatatttccagtgtcgaaagaaacaaagtaggactgatcgggaggagtaaaaaatattaaaataatg

SEQ ID NO: 62 - DNA, 156 bp, Artificial sequence
  Synthetic sequence
caattgggctaccttttttttgttttgtttgcaatggttaatctattgttaaaatttaaagtttcacttgaactttcaaataatgttcttatatttccagtgtcgaaagaaacaaagtaggactgatctctggggtgaataaaatttataataatg

SEQ ID NO: 63 - DNA, 156 bp, Artificial sequence
  Synthetic sequence
caattgggctaccttttttttgttttgtttgcaatggttaatctattgttaaaatttaaagtttcacttgaactttcaaataatgttcttatatttccagtgtcgaaagaaacaaagtaggactgatcccccattctattaaattttagaataatg

SEQ ID NO: 64 - DNA, 156 bp, Artificial sequence
  Synthetic sequence
caattgggctaccttttttttgttttgtttgcaatggttaatctattgttaaaatttaaagtttcacttgaactttcaaataatgttcttatatttccagtgtcgaaagaaacaaagtaggactgatcggtgttagctttaaatattagaataatg

SEQ ID NO: 65 - DNA, 156 bp, Artificial sequence
  Synthetic sequence
caattgggctaccttttttttgttttgtttgcaatggttaatctattgttaaaatttaaagtttcacttgaactttcaaataatgttcttatatttccagtgtcgaaagaaacaaagtaggactgatctagcactcttaaaaaaattaaaataatg

SEQ ID NO: 66 - DNA, 156 bp, Artificial sequence
  Synthetic sequence
caattgggctaccttttttttgttttgtttgcaatggttaatctattgttaaaatttaaagtttcacttgaactttcaaataatgttcttatatttccagtgtcgaaagaaacaaagtaggactgatcgtaatctttaaaaaaaataaaaataatg

SEQ ID NO: 67 - DNA, 156 bp, Artificial sequence
  Synthetic sequence
caattgggctaccttttttttgttttgtttgcaatggttaatctattgttaaaatttaaagtttcacttgaactttcaaataatgttcttatatttccagtgtcgaaagaaacaaagtaggactgatcgtccatcaatttaaaatttaaaataatg

SEQ ID NO: 68 - DNA, 156 bp, Artificial sequence
  Synthetic sequence
caattgggctaccttttttttgttttgtttgcaatggttaatctattgttgaaatttaaagtttcacttgaactttcaaataatgttcttatatttgcagtgtcgaaagaaacaaagtaggactgatcggcgcgactcacgcgccgatcagtaatg

SEQ ID NO: 69 - DNA, 156 bp, Artificial sequence
  Synthetic sequence
caattgggctaccttttttttgttttgtttgcaatggttaatctattgttgaaatttaaagtttcacttgaactttcaaataatgttcttatatttgcagtgtcgaaagaaacaaagtaggactgatcgggaggagtaaaaaatattaaaataatg

SEQ ID NO: 70 - DNA, 156 bp, Artificial sequence
  Synthetic sequence
caattgggctaccttttttttgttttgtttgcaatggttaatctattgttgaaatttaaagtttcacttgaactttcaaataatgttcttatatttgcagtgtcgaaagaaacaaagtaggactgatctctggggtgaataaaatttataataatg

SEQ ID NO: 71 - DNA, 156 bp, Artificial sequence
  Synthetic sequence
caattgggctaccttttttttgttttgtttgcaatggttaatctattgttgaaatttaaagtttcacttgaactttcaaataatgttcttatatttgcagtgtcgaaagaaacaaagtaggactgatcccccattctattaaattttagaataatg

SEQ ID NO: 72 - DNA, 156 bp, Artificial sequence
  Synthetic sequence
caattgggctaccttttttttgttttgtttgcaatggttaatctattgttgaaatttaaagtttcacttgaactttcaaataatgttcttatatttgcagtgtcgaaagaaacaaagtaggactgatcggtgttagctttaaatattagaataatg

SEQ ID NO: 73 - DNA, 156 bp, Artificial sequence
  Synthetic sequence
caattgggctaccttttttttgttttgtttgcaatggttaatctattgttgaaatttaaagtttcacttgaactttcaaataatgttcttatatttgcagtgtcgaaagaaacaaagtaggactgatctagcactcttaaaaaaattaaaataatg

SEQ ID NO: 74 - DNA, 156 bp, Artificial sequence
  Synthetic sequence
caattgggctaccttttttttgttttgtttgcaatggttaatctattgttgaaatttaaagtttcacttgaactttcaaataatgttcttatatttgcagtgtcgaaagaaacaaagtaggactgatcgtaatctttaaaaaaaataaaaataatg

SEQ ID NO: 75 - DNA, 156 bp, Artificial sequence
  Synthetic sequence
caattgggctaccttttttttgttttgtttgcaatggttaatctattgttgaaatttaaagtttcacttgaactttcaaataatgttcttatatttgcagtgtcgaaagaaacaaagtaggactgatcgtccatcaatttaaaatttaaaataatg

SEQ ID NO: 76 - DNA, 156 bp, Artificial sequence
  Synthetic sequence
caattgggctaccttttttttgttttgtttgcaatggttaatctattgttaaaatttaaagtttcacttgaactttcaaataatgttcttatatttgcagtgtcgaaagaaacaaagtaggactgatcggcgcgactcacgcgccgatcagtaatg

SEQ ID NO: 77 - DNA, 156 bp, Artificial sequence
  Synthetic sequence
caattgggctaccttttttttgttttgtttgcaatggttaatctattgttaaaatttaaagtttcacttgaactttcaaataatgttcttatatttgcagtgtcgaaagaaacaaagtaggactgatcgggaggagtaaaaaatattaaaataatg

SEQ ID NO: 78 - DNA, 156 bp, Artificial sequence
  Synthetic sequence
caattgggctaccttttttttgttttgtttgcaatggttaatctattgttaaaatttaaagtttcacttgaactttcaaataatgttcttatatttgcagtgtcgaaagaaacaaagtaggactgatctctggggtgaataaaatttataataatg

SEQ ID NO: 79 - DNA, 156 bp, Artificial sequence
  Synthetic sequence
caattgggctaccttttttttgttttgtttgcaatggttaatctattgttaaaatttaaagtttcacttgaactttcaaataatgttcttatatttgcagtgtcgaaagaaacaaagtaggactgatcccccattctattaaattttagaataatg

SEQ ID NO: 80 - DNA, 156 bp, Artificial sequence
  Synthetic sequence
caattgggctaccttttttttgttttgtttgcaatggttaatctattgttaaaatttaaagtttcacttgaactttcaaataatgttcttatatttgcagtgtcgaaagaaacaaagtaggactgatcggtgttagctttaaatattagaataatg

SEQ ID NO: 81 - DNA, 156 bp, Artificial sequence
  Synthetic sequence
caattgggctaccttttttttgttttgtttgcaatggttaatctattgttaaaatttaaagtttcacttgaactttcaaataatgttcttatatttgcagtgtcgaaagaaacaaagtaggactgatctagcactcttaaaaaaattaaaataatg

SEQ ID NO: 82 - DNA, 156 bp, Artificial sequence
  Synthetic sequence
caattgggctaccttttttttgttttgtttgcaatggttaatctattgttaaaatttaaagtttcacttgaactttcaaataatgttcttatatttgcagtgtcgaaagaaacaaagtaggactgatcgtaatctttaaaaaaaataaaaataatg

SEQ ID NO: 83 - DNA, 156 bp, Artificial sequence
  Synthetic sequence
caattgggctaccttttttttgttttgtttgcaatggttaatctattgttaaaatttaaagtttcacttgaactttcaaataatgttcttatatttgcagtgtcgaaagaaacaaagtaggactgatcgtccatcaatttaaaatttaaaataatg

SEQ ID NO: 84 - DNA, 714 bp, Artificial sequence
  Synthetic sequence
atgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaa

SEQ ID NO: 85 - DNA, 708 bp, Artificial sequence
  Synthetic sequence
atggtttcgaaaggggaagaagataacatggctatcattaaggagtttatgcgcttcaaggtgcacatggagggctctgtcaacggccacgagttcgaaatcgaaggtgaaggtgaaggtcgtccgtacgaaggtactcagaccgcaaagttgaaagttacaaaaggaggtccgttgcctttcgcttgggacattctgagcccgcaatttatgtacgggagcaaagcctatgttaaacatccggcggatattcccgattacctgaaactgtcattcccggaggggttcaagtgggaacgcgtcatgaactttgaagacggtggcgtggttacagtgactcaggattcgtcccttcaagatggcgaatttatctacaaagtcaaactgcgcgggacaaattttccgagtgacggtcctgttatgcagaagaagaccatggggtgggaagcaagctccgaacgcatgtaccccgaggacggtgcactcaaaggagaaatcaagcagcgtctgaaactgaaagatggcgggcactacgatgcagaagtgaaaaccacctataaggcgaaaaagcctgtacaactgccgggtgcctataatgtgaacattaaactggatataacgagtcacaacgaagactatacaatcgtcgagcagtatgagcgtgcggaaggacgtcattccactggtggaatggatgaactgtataag

SEQ ID NO: 86 - DNA, 513 bp, Artificial sequence
  Synthetic sequence
atggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggca

SEQ ID NO: 87 - DNA, 30 bp, Artificial sequence
  Synthetic sequence
aaggccatcctgacggatggcctttttttt

SEQ ID NO: 88 - DNA, 862 bp, Artificial sequence
  Synthetic sequence
gttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcat

SEQ ID NO: 89 - DNA, 268 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcat

SEQ ID NO: 90 - DNA, 598 bp, Artificial sequence
  Synthetic sequence
gttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgag

SEQ ID NO: 91 - DNA, 735 bp, Artificial sequence
  Synthetic sequence
atgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaa

SEQ ID NO: 92 - DNA, 1926 bp, Artificial sequence
  Synthetic sequence
ttattttgatgacattgatttttggaacatgaataaaagtttatctttttcgttcatgcggatattatcagaataaccgccttttgttatttgatacccgcatggcttaaccataaaaatgcctaagcccttagtgtatgaacttacttctgatgcatagtctttacttgtatttaatggaactttccctttaatatgacaccactcattattgcaactgatgtcttcaatctcagacatcattttttgcaaatctgtaatagctttggaacttgccgcttggggtatctgcaactcaaaatagagcatcggttcgagaatgtccacacctgactgttgcaaggccagcctgaagacataaggggtcagctgtctgaaatcagcaggtgtacttaccgggctataatactcggcttgagtaaaagttactttcagatcagtcacttcccatccatgtaacccggattggcaagacatacgaatcccttcaaaaacggcattttgaaaagaatggttcagataaccataggagatgtcactttcgatttgcaaccctgtccctaacggtaagggttcaagagtcagccctattgtggcccaataagggttgggcggcacttcgatctgaataatcttattgaccttttttacaggtcgttctttgtatatagtcttgatctcatcaaaatggacctttacggaaaatcgttcttccagcaatgtctgtatgatttccttttgggttaaaccatataacgagatttccaattcatcactatatgagtttatggaaaaggacaaagacgggtcttcaatccacaatgtattcagagcggatatcaccttgcttctctcttcgggcctgtctggccggacggaggatttgagagcgggatgctgatgcgataatccttgaatcaaacaaggttcagcacctaaataatttccgattcgaaaatcatccatatcctctacaatcgcgatatcattggcgcccacttcatcaacatttatctctctgccctgattgatagtttttagatttttaatcttgatgaatttttccgaatcgttgattcttacaacgtctcgaagtctcagacttccgtcaattatttttagaaaacttcttttatgtcctttggggtcatgctctatcttataaagataagatgaaagtctgtttgaaaccgatgccggaggaagtataaaagaagtgatggcgtccaacaactcattgataccgatattgaacattgctgatccatgtagcaccggatagactttggcttttgccacaagagcgattatcgtattccaataatcagccggtgaaatttcgctatccgccaaatatcgttctaatatattgtcgtcatggttgcatacaaattctttgtattcttcctttatatatgtttgggagcaaaccggataaaccgatccatcgacaacattttgcataaacaggacatcttgagacagatttgcttttatatccagatacaaacgctccaaattcacaccggctcggtcaatcttattgataaatataattgtcgggatttgcagcttctgtaaagtattgaacagcaactttgtctgcgcttgtatgccttcctttgcggataagatgaggactgctccatcaagcattttgaatgtccgctccacttccgcaataaaatccatgtgtcccggagtgtcaatgatattgcatttcacaccattccagataatagatgtcgtagaagcccgaacagtaattcctctacgtttctctatatccatagagtccgttatggtgtcaccattatccacacagccgcacttttccgttgctccactggcaaacagcagattctcggttacggaagtttttcctgcatcaatgtgagcaagaattcctaaatttataatattcat

SEQ ID NO: 93 - DNA, 1281 bp, Artificial sequence
  Synthetic sequence
tagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcat

SEQ ID NO: 94 - DNA, 2583 bp, Artificial sequence
  Synthetic sequence
gcggccgctccctatcagtgatagagattgacatccctatcagtgatagagatactgagcacggatctgaaagaggagaaaggatctatggcgagtagcgaagacgttatcaaagagttcatgcgtttcaaagttcgtatggaaggttccgttaacggtcacgagttcgaaatcgaaggtgaaggtgaaggtcgtccgtacgaaggtacccagaccgctaaactgaaagttaccaaaggtggtccgctgccgttcgcttgggacatcctgtccccgcagttccagtacggttccaaagcttacgttaaacacccggctgacatcccggactacctgaaactgtccttcccggaaggtttcaaatgggaacgtgttatgaacttcgaagacggtggtgttgttaccgttacccaggactcctccctgcaagacggtgagttcatctacaaagttaaactgcgtggtaccaacttcccgtccgacggtccggttatgcagaaaaaaaccatgggttgggaagcttccaccgaacgtatgtacccggaagacggtgctctgaaaggtgaaatcaaaatgcgtctgaaactgaaagacggtggtcactacgacgctgaagttaaaaccacctacatggctaaaaaaccggttcagctgccgggtgcttacaaaaccgacatcaaactggacatcacctcccacaacgaagactacaccatcgttgaacagtacgaacgtgctgaaggtcgtcactccaccggtgcttaataaggatctccaggcatcaaataaaacgaaaggctcagtcgaaagactgggcctttcgttttatctgttgtttgtcggtgaacgctctctactagagtcacactggctcaccttcgggtgggcctttctgcgtttatacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 95 - DNA, 5823 bp, Artificial sequence
  Synthetic sequence
gcggccgctggtctcccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatacgtctatttttttattgccaagttctaatgcttctatctcctgccattcatagaggctattatatgccatacatccgataagaatggagataagtatatatcccaactgtattgccttatagaaatttcctgaccgctccattattttgatgacattgatttttggaacatgaataaaagtttatctttttcgttcatgcggatattatcagaataaccgccttttgttatttgatacccgcatggcttaaccataaaaatgcctaagcccttagtgtatgaacttacttctgatgcatagtctttacttgtatttaatggaactttccctttaatatgacaccactcattattgcaactgatgtcttcaatctcagacatcattttttgcaaatctgtaatagctttggaacttgccgcttggggtatctgcaactcaaaatagagcatcggttcgagaatgtccacacctgactgttgcaaggccagcctgaagacataaggggtcagctgtctgaaatcagcaggtgtacttaccgggctataatactcggcttgagtaaaagttactttcagatcagtcacttcccatccatgtaacccggattggcaagacatacgaatcccttcaaaaacggcattttgaaaagaatggttcagataaccataggagatgtcactttcgatttgcaaccctgtccctaacggtaagggttcaagagtcagccctattgtggcccaataagggttgggcggcacttcgatctgaataatcttattgaccttttttacaggtcgttctttgtatatagtcttgatctcatcaaaatggacctttacggaaaatcgttcttccagcaatgtctgtatgatttccttttgggttaaaccatataacgagatttccaattcatcactatatgagtttatggaaaaggacaaagacgggtcttcaatccacaatgtattcagagcggatatcaccttgcttctctcttcgggcctgtctggccggacggaggatttgagagcgggatgctgatgcgataatccttgaatcaaacaaggttcagcacctaaataatttccgattcgaaaatcatccatatcctctacaatcgcgatatcattggcgcccacttcatcaacatttatctctctgccctgattgatagtttttagatttttaatcttgatgaatttttccgaatcgttgattcttacaacgtctcgaagtctcagacttccgtcaattatttttagaaaacttcttttatgtcctttggggtcatgctctatcttataaagataagatgaaagtctgtttgaaaccgatgccggaggaagtataaaagaagtgatggcgtccaacaactcattgataccgatattgaacattgctgatccatgtagcaccggatagactttggcttttgccacaagagcgattatcgtattccaataatcagccggtgaaatttcgctatccgccaaatatcgttctaatatattgtcgtcatggttgcatacaaattctttgtattcttcctttatatatgtttgggagcaaaccggataaaccgatccatcgacaacattttgcataaacaggacatcttgagacagatttgcttttatatccagatacaaacgctccaaattcacaccggctcggtcaatcttattgataaatataattgtcgggatttgcagcttctgtaaagtattgaacagcaactttgtctgcgcttgtatgccttcctttgcggataagatgaggactgctccatcaagcattttgaatgtccgctccacttccgcaataaaatccatgtgtcccggagtgtcaatgatattgcatttcacaccattccagataatagatgtcgtagaagcccgaacagtaattcctctacgtttctctatatccatagagtccgttatggtgtcaccattatccacacagccgcacttttccgttgctccactggcaaacagcagattctcggttacggaagtttttcctgcatcaatgtgagcaagaattcctaaatttataatattcatttggattaagcaataatatactacaatagatgcattgtcgaaacgcaccttttaatacctcctcgtagcatatgagaactacaggattcctaactcgtattaatatgtatattattactgccgcataacgattacaaaattacacaaaaaaatatatctaacaaaagtaggaggattttttaactttttaccatagacattttattagggaaacgtaggttcaactggtaagtacaaataagtagaaatgtttgaacaacactgttttaggaagttgaaaaatcaagtttctctctcggtatagcgtttattttggccaatatcttctttagtttggcatttgagtatttcccattcgtgttctatttagctccttattatgagtatgtagcaagttgcttatcaaattcagcctctttgagggtcaaatatggttttgcaaatggtgactgacaagacataaacaaggtcagcaggattttttacataaatggacatgaatgtatataacggggtttgagggccaatggaacgaaaacgtacgttaaggagataacgcgtggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctatgagacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 96 - DNA, 4072 bp, Artificial sequence
  Synthetic sequence
gcggccgctggtctcccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctatgagacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 97 - DNA, 4243 bp, Artificial sequence
  Synthetic sequence
gcggccgctggtctcccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggacttgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 98 - DNA, 2495 bp, Artificial sequence
  Synthetic sequence
gcggccgctggtctccaatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctgagaccacctgcaggagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 99 - DNA, 2420 bp, Artificial sequence
  Synthetic sequence
gcggccgctggtctccaatggtttcgaaaggggaagaagataacatggctatcattaaggagtttatgcgcttcaaggtgcacatggagggctctgtcaacggccacgagttcgaaatcgaaggtgaaggtgaaggtcgtccgtacgaaggtactcagaccgcaaagttgaaagttacaaaaggaggtccgttgcctttcgcttgggacattctgagcccgcaatttatgtacgggagcaaagcctatgttaaacatccggcggatattcccgattacctgaaactgtcattcccggaggggttcaagtgggaacgcgtcatgaactttgaagacggtggcgtggttacagtgactcaggattcgtcccttcaagatggcgaatttatctacaaagtcaaactgcgcgggacaaattttccgagtgacggtcctgttatgcagaagaagaccatggggtgggaagcaagctccgaacgcatgtaccccgaggacggtgcactcaaaggagaaatcaagcagcgtctgaaactgaaagatggcgggcactacgatgcagaagtgaaaaccacctataaggcgaaaaagcctgtacaactgccgggtgcctataatgtgaacattaaactggatataacgagtcacaacgaagactatacaatcgtcgagcagtatgagcgtgcggaaggacgtcattccactggtggaatggatgaactgtataagtaaatcctgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 100 - DNA, 2225 bp, Artificial sequence
  Synthetic sequence
gcggccgctggtctccaatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 101 - DNA, 4307 bp, Artificial sequence
  Synthetic sequence
ttgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtaggcggccgcggtctccatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatgcatcaaaattcgttttctctacgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagtgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatga

SEQ ID NO: 102 - DNA, 5119 bp, Artificial sequence
  Synthetic sequence
gcggccgctggtctccaatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagtgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 103 - DNA, 5014 bp, Artificial sequence
  Synthetic sequence
gcggccgctggtctccaatggtttcgaaaggggaagaagataacatggctatcattaaggagtttatgcgcttcaaggtgcacatggagggctctgtcaacggccacgagttcgaaatcgaaggtgaaggtgaaggtcgtccgtacgaaggtactcagaccgcaaagttgaaagttacaaaaggaggtccgttgcctttcgcttgggacattctgagcccgcaatttatgtacgggagcaaagcctatgttaaacatccggcggatattcccgattacctgaaactgtcattcccggaggggttcaagtgggaacgcgtcatgaactttgaagacggtggcgtggttacagtgactcaggattcgtcccttcaagatggcgaatttatctacaaagtcaaactgcgcgggacaaattttccgagtgacggtcctgttatgcagaagaagaccatggggtgggaagcaagctccgaacgcatgtaccccgaggacggtgcactcaaaggagaaatcaagcagcgtctgaaactgaaagatggcgggcactacgatgcagaagtgaaaaccacctataaggcgaaaaagcctgtacaactgccgggtgcctataatgtgaacattaaactggatataacgagtcacaacgaagactatacaatcgtcgagcagtatgagcgtgcggaaggacgtcattccactggtggaatggatgaactgtataagtaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagtgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 104 - DNA, 4819 bp, Artificial sequence
  Synthetic sequence
gcggccgctggtctccaatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagtgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 105 - DNA, 1876 bp, Artificial sequence
  Synthetic sequence
gcggccgctggtctcctctagataaaacgaaaggctcagtcgaaagactgggcctttcgttttacaattgggctaccttttttttgtaaaaaaaaaccccgcccctgacagggcggggttttttttttcacttgaactttcaaataatgttcttataaaaccagtgtcgaaagaaacaaagtaggacttgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 106 - DNA, 1876 bp, Artificial sequence
  Synthetic sequence
gcggccgctggtctcctctagataaaacgaaaggctcagtcgaaagactgggcctttcgttttacaattgggctaccttttttttgtaaaaaaaaaccccgcccctgacagggcggggttttttttttcacttgaactttcaaataatgttcttatatatgcagtgtcgaaagaaacaaagtaggacttgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 107 - DNA, 1876 bp, Artificial sequence
  Synthetic sequence
gcggccgctggtctcctctagataaaacgaaaggctcagtcgaaagactgggcctttcgttttacaattgggctaccttttttttgttttgtttgcaatggttaatctattgttaaaatttaaagtttcacttgaactttcaaataatgttcttatatgtgcagtgtcgaaagaaacaaagtaggacttgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 108 - DNA, 1876 bp, Artificial sequence
  Synthetic sequence
gcggccgctggtctcctctagataaaacgaaaggctcagtcgaaagactgggcctttcgttttacaattgggctaccttttttttgttttgtttgcaatggttaatctattgttaacatttaaagtttcacttgaactttcaaataatgttcttatattttcagtgtcgaaagaaacaaagtaggacttgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 109 - DNA, 1876 bp, Artificial sequence
  Synthetic sequence
gcggccgctggtctcctctagataaaacgaaaggctcagtcgaaagactgggcctttcgttttacaattgggctaccttttttttgttttgtttgcaatggttaatctattgttaaaatttaaagtttcacttgaactttcaaataatgttcttctatttgcagtgtcgaaagaaacaaagtaggacttgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 110 - DNA, 1876 bp, Artificial sequence
  Synthetic sequence
gcggccgctggtctcctctagataaaacgaaaggctcagtcgaaagactgggcctttcgttttacaattgggctaccttttttttgttttgtttgcaatggttaatctattgttaaaatttaaagtttcacttgaactttcaaataatgttcttatatttccagtgtcgaaagaaacaaagtaggacttgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 111 - DNA, 1876 bp, Artificial sequence
  Synthetic sequence
gcggccgctggtctcctctagataaaacgaaaggctcagtcgaaagactgggcctttcgttttacaattgggctaccttttttttgttttgtttgcaatggttaatctattgttgaaatttaaagtttcacttgaactttcaaataatgttcttatatttgcagtgtcgaaagaaacaaagtaggacttgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 112 - DNA, 1876 bp, Artificial sequence
  Synthetic sequence
gcggccgctggtctcctctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggacttgagaccacctgcaggaaggccatcctgacggatggccttttttttagacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattgatcgggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttgatatcgagctcgcttggactcctgttgatagatccagtaatgacctcagaactccatctggatttgttcagaacgctcggttgccgccgggcgttttttattggtag

SEQ ID NO: 113 - DNA, 6329 bp, Artificial sequence
  Synthetic sequence
  misc_feature (528)..(536): n is a, c, g, or t
  misc_feature (548)..(548): n is a, c, g, or t
tctaggctacttttgcacccgctttccaagagaagaaagccttgataaattgacttagtgtaaaagcaagtgtctgcttaaccataagaacaaaaaaacttccgataaagtttggaagataaagctaaaagttcttatctttgcagtccgattcgcaaagaaaaggtgttacgcttttcttctttaccttctttccctttcgctaagagagcctgaaaaacgatagaaaaagaaaaacgaaaaaaaaacttccgaaaatatttggtagttaaaataaaacctcttacctttgcacccgcttttaaaacgaaagcaagatgttctttgaaatattgataaacaatacaagtagtacaagaaaaaaatagaaccgtcaatacttgtcttatatgtagtaatatgtatgagtcataaggtattaatgaagtcaataaattgtacggcatcctgaacagagcaaaaatcagctttatgctgactaacaatacttttacaatgaagagtttgatcctggctcaggactgatcnnnnnnnnnwwwaaawwtwanaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaa

SEQ ID NO: 114 - DNA, 6314 bp, Artificial sequence
  Synthetic sequence
  misc_feature (513)..(521): n is a, c, g, or t
  misc_feature (533)..(533): n is a, c, g, or t
tctactttccctggggtggctagcacaatgatggcttgccctgatatggaagtggaaggtaagattctgaaagcaatgaatgaagtgaagtcgttcgataaactttccggtggtggaatcggtttgtatgacgcaaataatgcgttggtgattgtacttgaaaagtaagatatacgtattatattaaataggtatgcctgtgtcgcacataacgatacaggcatattttttattcctttatgatctattcttttgctttattgaaccagagctgtttccatttgtttaatgagtcgatagctgtctggcttctatgtgacttgacagcagtcatttcgatttaaaactgtcgttttggcagaaaatatgtcacgtattcgtccgatttctttttggcacatggtttgttttttaatcagcgtccgtttgaaagcccttacaaagagaaagaaaacaaccggacaaaaagaaattgaataataataaataaaaagaataacgatcgactgatcnnnnnnnnnwwwaaawwtwanaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaa

SEQ ID NO: 115 - DNA, 6314 bp, Artificial sequence
  Synthetic sequence
  misc_feature (513)..(521): n is a, c, g, or t
  misc_feature (533)..(533): n is a, c, g, or t
tctattattctctacgttcaccccgttgaggtaggtgtccggacgtcccgtctccggattggggcggaaagtaatccggatatcccggattgcttctttcagcttctccgtatcgataacgtctccgttaaatatcccgttttcaatactatataaggtgactgcgcgatacattgccccactatctatataaatgtatcctacttcgcgggcgagatctttggccattgtactttttccgcaggaggaaaagccgtcgattgcgattgttatctttttcatattatctgcttcttatatttgtccgccaaagatacgcttattttgaaaatcagccatagatttgactgtaaaagcaactgaatgagtatgaaagaattaaaaaagttaaaaagccggataaaaagatacaaagaaacggacggttatctgaaaatgtagtatatttgcccagagacacataggaagacacttttttttattaatcattatattaacaaaattgactgatcnnnnnnnnnwwwaaawwtwanaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaa

SEQ ID NO: 116 - DNA, 6314 bp, Artificial sequence
  Synthetic sequence
  misc_feature (513)..(521): n is a, c, g, or t
  misc_feature (533)..(533): n is a, c, g, or t
tctatatctttataaggatatgtatcttccagcgtgtacttatcatacagcagctctttggtgatttgaatttcttccggagtaatctttttgacgacaggttctgccacagtttccgcaattgtatcctgtgccagcgaatcgacctgcaaagtttcatcagaagatttttgtcctgtacgtgaagtgcaggaacagagtacgcaaaaagcgatggatatgccaaaacttattttattcatataatctatacagttcatcttggggttcgtttacgaatatacgttattataaggaataatccgcttctattgtttaaaaagtgtggaacaaatatgcttttttgccattaataacctgttgtcagtcattttgtcagtcaatttctgccaaacaatcattattttgctttggcatacttttcgcaactgatttagcgtcttcttcaagaagaggacaaatcatgaatataatgtataacaaataaaatcaaaaaaaagaactgactgatcnnnnnnnnnwwwaaawwtwanaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaa

SEQ ID NO: 117 - DNA, 6314 bp, Artificial sequence
  Synthetic sequence
  misc_feature (513)..(521): n is a, c, g, or t
  misc_feature (533)..(533): n is a, c, g, or t
tctactgatgtcgggtgaaacagcagcgccagagattggtaatactcttccccttcagaacattccggttggtactgtaattcacaatattgagttacgtccgggacagggtgctgctctggttagatcagctggaaactttgctcagttaacttctcgtgagggtaagtattgtgtgattaaattgccttcaggtgaagtaagacagattcttagcacttgtaaagctactatcggtagtgttggtaactcagatcatggattggaacgctcaggtaaggctggacgctctcgttggcaaggtcgtcgtcctcgtaaccgtggtgttgtaatgaacccggttgatcacccgatgggtggtggtgaaggacgttcttccggaggacatccaagatctcgtaagggattgtacgctaagggacttaagactagagctcctaagaaacaatcgtctaagtacattattgagagaagaaaaaagtaatctgattaattgagtaaactgactgatcnnnnnnnnnwwwaaawwtwanaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaa

SEQ ID NO: 118 - DNA, 6064 bp, Artificial sequence
  Synthetic sequence
  misc_feature (263)..(271): n is a, c, g, or t
  misc_feature (283)..(283): n is a, c, g, or t
tctaatccatctttgcccacaatcagagtgacaactttggcaagaatgcggaagtagctcagttgatagagcattagccttccaagctgagggtcgcgggtttgagccccgtcttccgctcttttttttcttgctgttatagctcagcggtagagcacttccttggtaaggaagaggtcccgggttcaagtcccggtaacagctcataaagatgtaaatgctgattattaatcaaataaataacaagtaaagctgactgatcnnnnnnnnnwwwaaawwtwanaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaa

SEQ ID NO: 119 - DNA, 6125 bp, Artificial sequence
  Synthetic sequence
  misc_feature (324)..(332): n is a, c, g, or t
  misc_feature (344)..(344): n is a, c, g, or t
tctagatgatctggaagaagcaatgaaagctgctgttaagtctccgaatcaggtattgttcctgacaggtgtattcccatccggtaaacgcggatactttgcagttgatctgactcaggaataaattataaattaaggtaagaagattgtaggataagctaatgaaatagaaaaaggatgccgtcacacaacttgtcggcattcttttttgttttattagttgaaaatatagtgaaaaagttgcctaaatatgtatgttaacaaattatttgtcgtaactttgcactccaaatctgtttttaacatatggcactagactgatcnnnnnnnnnwwwaaawwtwanaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaa

SEQ ID NO: 120 - DNA, 5978 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggactgatctatggattcaaaaaaatttaaaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 121 - DNA, 6335 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctaggctacttttgcacccgctttccaagagaagaaagccttgataaattgacttagtgtaaaagcaagtgtctgcttaaccataagaacaaaaaaacttccgataaagtttggaagataaagctaaaagttcttatctttgcagtccgattcgcaaagaaaaggtgttacgcttttcttctttaccttctttccctttcgctaagagagcctgaaaaacgatagaaaaagaaaaacgaaaaaaaaacttccgaaaatatttggtagttaaaataaaacctcttacctttgcacccgcttttaaaacgaaagcaagatgttctttgaaatattgataaacaatacaagtagtacaagaaaaaaatagaaccgtcaatacttgtcttatatgtagtaatatgtatgagtcataaggtattaatgaagtcaataaattgtacggcatcctgaacagagcaaaaatcagctttatgctgactaacaatacttttacaatgaagagtttgatcctggctcaggactgatctatggattcaaaaaaatttaaaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatgcatcaaaattcgttttctctacgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 122 - DNA, 6131 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagatgatctggaagaagcaatgaaagctgctgttaagtctccgaatcaggtattgttcctgacaggtgtattcccatccggtaaacgcggatactttgcagttgatctgactcaggaataaattataaattaaggtaagaagattgtaggataagctaatgaaatagaaaaaggatgccgtcacacaacttgtcggcattcttttttgttttattagttgaaaatatagtgaaaaagttgcctaaatatgtatgttaacaaattatttgtcgtaactttgcactccaaatctgtttttaacatatggcactagactgatctatggattcaaaaaaatttaaaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatgcatcaaaattcgttttctctacgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 123 - DNA, 6320 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctatatctttataaggatatgtatcttccagcgtgtacttatcatacagcagctctttggtgatttgaatttcttccggagtaatctttttgacgacaggttctgccacagtttccgcaattgtatcctgtgccagcgaatcgacctgcaaagtttcatcagaagatttttgtcctgtacgtgaagtgcaggaacagagtacgcaaaaagcgatggatatgccaaaacttattttattcatataatctatacagttcatcttggggttcgtttacgaatatacgttattataaggaataatccgcttctattgtttaaaaagtgtggaacaaatatgcttttttgccattaataacctgttgtcagtcattttgtcagtcaatttctgccaaacaatcattattttgctttggcatacttttcgcaactgatttagcgtcttcttcaagaagaggacaaatcatgaatataatgtataacaaataaaatcaaaaaaaagaactgactgatctatggattcaaaaaaatttaaaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatgcatcaaaattcgttttctctacgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 124 - DNA, 6320 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctattattctctacgttcaccccgttgaggtaggtgtccggacgtcccgtctccggattggggcggaaagtaatccggatatcccggattgcttctttcagcttctccgtatcgataacgtctccgttaaatatcccgttttcaatactatataaggtgactgcgcgatacattgccccactatctatataaatgtatcctacttcgcgggcgagatctttggccattgtactttttccgcaggaggaaaagccgtcgattgcgattgttatctttttcatattatctgcttcttatatttgtccgccaaagatacgcttattttgaaaatcagccatagatttgactgtaaaagcaactgaatgagtatgaaagaattaaaaaagttaaaaagccggataaaaagatacaaagaaacggacggttatctgaaaatgtagtatatttgcccagagacacataggaagacacttttttttattaatcattatattaacaaaattgactgatctatggattcaaaaaaatttaaaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatgcatcaaaattcgttttctctacgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 125 - DNA, 6320 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctactgatgtcgggtgaaacagcagcgccagagattggtaatactcttccccttcagaacattccggttggtactgtaattcacaatattgagttacgtccgggacagggtgctgctctggttagatcagctggaaactttgctcagttaacttctcgtgagggtaagtattgtgtgattaaattgccttcaggtgaagtaagacagattcttagcacttgtaaagctactatcggtagtgttggtaactcagatcatggattggaacgctcaggtaaggctggacgctctcgttggcaaggtcgtcgtcctcgtaaccgtggtgttgtaatgaacccggttgatcacccgatgggtggtggtgaaggacgttcttccggaggacatccaagatctcgtaagggattgtacgctaagggacttaagactagagctcctaagaaacaatcgtctaagtacattattgagagaagaaaaaagtaatctgattaattgagtaaactgactgatctatggattcaaaaaaatttaaaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatgcatcaaaattcgttttctctacgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 126 - DNA, 6070 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctaatccatctttgcccacaatcagagtgacaactttggcaagaatgcggaagtagctcagttgatagagcattagccttccaagctgagggtcgcgggtttgagccccgtcttccgctcttttttttcttgctgttatagctcagcggtagagcacttccttggtaaggaagaggtcccgggttcaagtcccggtaacagctcataaagatgtaaatgctgattattaatcaaataaataacaagtaaagctgactgatctatggattcaaaaaaatttaaaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatgcatcaaaattcgttttctctacgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 127 - DNA, 6320 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctactttccctggggtggctagcacaatgatggcttgccctgatatggaagtggaaggtaagattctgaaagcaatgaatgaagtgaagtcgttcgataaactttccggtggtggaatcggtttgtatgacgcaaataatgcgttggtgattgtacttgaaaagtaagatatacgtattatattaaataggtatgcctgtgtcgcacataacgatacaggcatattttttattcctttatgatctattcttttgctttattgaaccagagctgtttccatttgtttaatgagtcgatagctgtctggcttctatgtgacttgacagcagtcatttcgatttaaaactgtcgttttggcagaaaatatgtcacgtattcgtccgatttctttttggcacatggtttgttttttaatcagcgtccgtttgaaagcccttacaaagagaaagaaaacaaccggacaaaaagaaattgaataataataaataaaaagaataacgatcgactgatctatggattcaaaaaaatttaaaataatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatgcatcaaaattcgttttctctacgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 128 - DNA, 5960 bp, Artificial sequence
  Synthetic sequence
cccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagagtttgcaatggttaatctattgttaaaatttaaagtttcacttgaactttcaaataatgttcttatatttgcagtgtcgaaagaaacaaaggactgatcacacaacatttaaaaaataacattatgaaagcactcgaaaagagattcaaaggtaatattaacaataatttattttcaatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaatt

SEQ ID NO: 129 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgtaaaaaaaaaccccgcccctgacagggcggggttttttttttcacttgaactttcaaataatgttcttataaaaccagtgtcgaaagaaacaaagtaggactgatcgtccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 130 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgtaaaaaaaaaccccgcccctgacagggcggggttttttttttcacttgaactttcaaataatgttcttatatatgcagtgtcgaaagaaacaaagtaggactgatcgtccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 131 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatgtgcagtgtcgaaagaaacaaagtaggactgatcgtccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 132 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaacatttaaagtttcacttgaactttcaaataatgttcttatattttcagtgtcgaaagaaacaaagtaggactgatcgtccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 133 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttctatttgcagtgtcgaaagaaacaaagtaggactgatcgtccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 134 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttccagtgtcgaaagaaacaaagtaggactgatcgtccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 135 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttgaaatttaaagtttcacttgaactttcaaataatgttcttatatttgcagtgtcgaaagaaacaaagtaggactgatcgtccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 136 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggactgatcgtccatcaatttaaaatttaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 137 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggactgatcggcgcgactcacgcgccgatcagtaatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 138 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggactgatcgggaggagtaaaaaatattaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 139 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggactgatctctggggtgaataaaatttataataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 140 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggactgatcccccattctattaaattttagaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 141 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggactgatcggtgttagctttaaatattagaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 142 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggactgatctagcactcttaaaaaaattaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 143 - DNA, 5678 bp, Artificial sequence
  Synthetic sequence
cgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggactgatcgtaatctttaaaaaaaataaaaataatggtttttactctggaagattttgttggcgattggcgtcagaccgcgggttataatttggatcaagtcctggaacagggtggcgtaagctctctgttccagaacctgggtgtgagcgtgacgccgattcagcgcatcgttctgtccggcgagaacggtctgaaaattgatattcatgtgatcatcccgtacgaaggcctgagcggtgaccaaatgggtcaaatcgagaaaatctttaaagtcgtctacccagttgacgatcaccacttcaaggttatcttgcattacggtacgctggtgattgatggtgtgaccccgaatatgattgactatttcggccgtccgtatgaaggcattgccgtttttgacggtaaaaagatcaccgtcaccggtaccctgtggaatggcaataagattattgacgagcgtctgattaacccggacggcagcctgctgttccgcgtgaccatcaacggtgtcacgggttggcgtctgtgcgagcgcatcctggcataaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgac

SEQ ID NO: 144 - DNA, 6031 bp, Artificial sequence
  Synthetic sequence
caccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggactgatcacacaacatttaaaaaataacattatgaaagcactcgaaaagagattcaaaggtaatattaacaataatttattttcaatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccga

SEQ ID NO: 145 - DNA, 5855 bp, Artificial sequence
  Synthetic sequence
cgtctcgattcagatctaaaggatccaatctagagtttgcaatggttaatctattgttaaaatttaaagtttcacttgaactttcaaataatgttcttatatttgcagtgtcgaaagaaacaaaggactgatcacacaacatttaaaaaataacattatgaaagcactcgaaaagagattcaaaggtaatattaacaataatttattttcaatggtttcgaaaggggaagaagataacatggctatcattaaggagtttatgcgcttcaaggtgcacatggagggctctgtcaacggccacgagttcgaaatcgaaggtgaaggtgaaggtcgtccgtacgaaggtactcagaccgcaaagttgaaagttacaaaaggaggtccgttgcctttcgcttgggacattctgagcccgcaatttatgtacgggagcaaagcctatgttaaacatccggcggatattcccgattacctgaaactgtcattcccggaggggttcaagtgggaacgcgtcatgaactttgaagacggtggcgtggttacagtgactcaggattcgtcccttcaagatggcgaatttatctacaaagtcaaactgcgcgggacaaattttccgagtgacggtcctgttatgcagaagaagaccatggggtgggaagcaagctccgaacgcatgtaccccgaggacggtgcactcaaaggagaaatcaagcagcgtctgaaactgaaagatggcgggcactacgatgcagaagtgaaaaccacctataaggcgaaaaagcctgtacaactgccgggtgcctataatgtgaacattaaactggatataacgagtcacaacgaagactatacaatcgtcgagcagtatgagcgtgcggaaggacgtcattccactggtggaatggatgaactgtataagtaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttc

SEQ ID NO: 146 - DNA, 6987 bp, Artificial sequence
  Synthetic sequence
gaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttccagtgtcgaaagaaacaaagtaggactgatcacacaacatttaaaaaataacattatgaaagcactcgaaaagagattcaaaggtaatattaacaataatttattttcaatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagagtttgcaatggttaatctattgttaaaatttaaagtttcacttgaactttcaaataatgttcttatatttgcagtgtcgaaagaaacaaaggactgatcacacaacatttaaaaaataacattatgaaagcactcgaaaagagattcaaaggtaatattaacaataatttattttcaatggtttcgaaaggggaagaagataacatggctatcattaaggagtttatgcgcttcaaggtgcacatggagggctctgtcaacggccacgagttcgaaatcgaaggtgaaggtgaaggtcgtccgtacgaaggtactcagaccgcaaagttgaaagttacaaaaggaggtccgttgcctttcgcttgggacattctgagcccgcaatttatgtacgggagcaaagcctatgttaaacatccggcggatattcccgattacctgaaactgtcattcccggaggggttcaagtgggaacgcgtcatgaactttgaagacggtggcgtggttacagtgactcaggattcgtcccttcaagatggcgaatttatctacaaagtcaaactgcgcgggacaaattttccgagtgacggtcctgttatgcagaagaagaccatggggtgggaagcaagctccgaacgcatgtaccccgaggacggtgcactcaaaggagaaatcaagcagcgtctgaaactgaaagatggcgggcactacgatgcagaagtgaaaaccacctataaggcgaaaaagcctgtacaactgccgggtgcctataatgtgaacattaaactggatataacgagtcacaacgaagactatacaatcgtcgagcagtatgagcgtgcggaaggacgtcattccactggtggaatggatgaactgtataagtaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattg

SEQ ID NO: 147 - DNA, 6987 bp, Artificial sequence
  Synthetic sequence
gaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggactgatcacacaacatttaaaaaataacattatgaaagcactcgaaaagagattcaaaggtaatattaacaataatttattttcaatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagagtttgcaatggttaatctattgttaaaatttaaagtttcacttgaactttcaaataatgttcttatatttgcagtgtcgaaagaaacaaaggactgatcacacaacatttaaaaaataacattatgaaagcactcgaaaagagattcaaaggtaatattaacaataatttattttcaatggtttcgaaaggggaagaagataacatggctatcattaaggagtttatgcgcttcaaggtgcacatggagggctctgtcaacggccacgagttcgaaatcgaaggtgaaggtgaaggtcgtccgtacgaaggtactcagaccgcaaagttgaaagttacaaaaggaggtccgttgcctttcgcttgggacattctgagcccgcaatttatgtacgggagcaaagcctatgttaaacatccggcggatattcccgattacctgaaactgtcattcccggaggggttcaagtgggaacgcgtcatgaactttgaagacggtggcgtggttacagtgactcaggattcgtcccttcaagatggcgaatttatctacaaagtcaaactgcgcgggacaaattttccgagtgacggtcctgttatgcagaagaagaccatggggtgggaagcaagctccgaacgcatgtaccccgaggacggtgcactcaaaggagaaatcaagcagcgtctgaaactgaaagatggcgggcactacgatgcagaagtgaaaaccacctataaggcgaaaaagcctgtacaactgccgggtgcctataatgtgaacattaaactggatataacgagtcacaacgaagactatacaatcgtcgagcagtatgagcgtgcggaaggacgtcattccactggtggaatggatgaactgtataagtaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattg

SEQ ID NO: 148 - DNA, 6031 bp, Artificial sequence
  Synthetic sequence
caccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcacggaattgatccccctcgaattggaattcgttccgtctcgattcagatctaaaggatccaatctagataaaacgaaaggctcagtcgaaagactgggcctttcgttttacaattgggctaccttttttttgttttgtttgcaatggttaatctattgttaaaatttaaagtttcacttgaactttcaaataatgttcttatatttccagtgtcgaaagaaacaaagtaggactgatcacacaacatttaaaaaataacattatgaaagcactcgaaaagagattcaaaggtaatattaacaataatttattttcaatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgtatcgagacgactagtgtaattgcctatcttccagtgatggaacagcatttgtgcattggctgcaacaatcagccttacttgtgcctgttctatttccgaaccgaccgcttgtatgaatccatcaaaattcgttttctctatgttggattccttgttgctcatattgtgatgataatttctacaaatatagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtccttcttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcgctggtgtctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgctctttacccgctgcttatctgcatcccatttggctacgtcaatccggtagcccgttgtaaactcgatgcgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcggctgtttttgttttatttaagataatacaaccactacataataaaagagtagcgatattaaaagaatccgatgagaaaagactaatatttatctatccattcagtttgatttttcaggactttacatcgtcctgaaagtatttgttggtaccgaggacgcgacagctgcagacgcgttatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgggacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatcatggccgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccga

SEQ ID NO: 149 - protein, 4 aa, Artificial sequence
  Synthetic sequence
AAAA

SEQ ID NO: 150 - DNA, 120 bp, Artificial sequence; identical to SEQ ID NO: 8
  Synthetic sequence

SEQ ID NO: 151 - DNA, 120 bp, Artificial sequence
  Synthetic sequence
caattgggctaccttttttttgttatgtttgcaatggttaatctattgttaaaatttaaagtttcacttgaactttcaaataatgttcttatatttgcagtgtcgaaagaaacaaagtag

SEQ ID NO: 152 - DNA, 120 bp, Artificial sequence
  Synthetic sequence
caattgggctaccttttttttgttctgtttgcaatggttaatctattgttaaaatttaaagtttcacttgaactttcaaataatgttcttatatttgcagtgtcgaaagaaacaaagtag

SEQ ID NO: 153 - DNA, 120 bp, Artificial sequence
  Synthetic sequence
caattgggctaccttttttttgttgtgtttgcaatggttaatctattgttaaaatttaaagtttcacttgaactttcaaataatgttcttatatttgcagtgtcgaaagaaacaaagtag

SEQ ID NO: 154 - DNA, 120 bp, Artificial sequence
  Synthetic sequence
caattgggctaccttttttttgtttagtttgcaatggttaatctattgttaaaatttaaagtttcacttgaactttcaaataatgttcttatatttgcagtgtcgaaagaaacaaagtag

SEQ ID NO: 155 - DNA, 120 bp, Artificial sequence
  Synthetic sequence
caattgggctaccttttttttgtttcgtttgcaatggttaatctattgttaaaatttaaagtttcacttgaactttcaaataatgttcttatatttgcagtgtcgaaagaaacaaagtag

SEQ ID NO: 156 - DNA, 120 bp, Artificial sequence
  Synthetic sequence
caattgggctaccttttttttgtttggtttgcaatggttaatctattgttaaaatttaaagtttcacttgaactttcaaataatgttcttatatttgcagtgtcgaaagaaacaaagtag

SEQ ID NO: 157 - DNA, 120 bp, Artificial sequence
  Synthetic sequence
caattgggctaccttttttttgttttatttgcaatggttaatctattgttaaaatttaaagtttcacttgaactttcaaataatgttcttatatttgcagtgtcgaaagaaacaaagtag

SEQ ID NO: 158 - DNA, 120 bp, Artificial sequence
  Synthetic sequence
caattgggctaccttttttttgttttctttgcaatggttaatctattgttaaaatttaaagtttcacttgaactttcaaataatgttcttatatttgcagtgtcgaaagaaacaaagtag

SEQ ID NO: 159 - DNA, 120 bp, Artificial sequence
  Synthetic sequence
caattgggctaccttttttttgttttttttgcaatggttaatctattgttaaaatttaaagtttcacttgaactttcaaataatgttcttatatttgcagtgtcgaaagaaacaaagtag

SEQ ID NO: 160 - DNA, 120 bp, Artificial sequence
  Synthetic sequence
caattgggctaccttttttttgttttgcttgcaatggttaatctattgttaaaatttaaagtttcacttgaactttcaaataatgttcttatatttgcagtgtcgaaagaaacaaagtag

SEQ ID NO: 161 - DNA, 120 bp, Artificial sequence
  Synthetic sequence
caattgggctaccttttttttgttttggttgcaatggttaatctattgttaaaatttaaagtttcacttgaactttcaaataatgttcttatatttgcagtgtcgaaagaaacaaagtag

SEQ ID NO: 162 - DNA, 120 bp, Artificial sequence
  Synthetic sequence
caattgggctaccttttttttgttttgtatgcaatggttaatctattgttaaaatttaaagtttcacttgaactttcaaataatgttcttatatttgcagtgtcgaaagaaacaaagtag

SEQ ID NO: 163 - DNA, 120 bp, Artificial sequence
  Synthetic sequence
caattgggctaccttttttttgttttgtctgcaatggttaatctattgttaaaatttaaagtttcacttgaactttcaaataatgttcttatatttgcagtgtcgaaagaaacaaagtag

SEQ ID NO: 164 - DNA, 120 bp, Artificial sequence
  Synthetic sequence
caattgggctaccttttttttgttttgtgtgcaatggttaatctattgttaaaatttaaagtttcacttgaactttcaaataatgttcttatatttgcagtgtcgaaagaaacaaagtag

SEQ ID NO: 165 - DNA, 120 bp, Artificial sequence
  Synthetic sequence
caattgggctaccttttttttgttttgttagcaatggttaatctattgttaaaatttaaagtttcacttgaactttcaaataatgttcttatatttgcagtgtcgaaagaaacaaagtag

SEQ ID NO: 166 - DNA, 120 bp, Artificial sequence
  Synthetic sequence
caattgggctaccttttttttgttttgttcgcaatggttaatctattgttaaaatttaaagtttcacttgaactttcaaataatgttcttatatttgcagtgtcgaaagaaacaaagtag

SEQ ID NO: 167 - DNA, 120 bp, Artificial sequence
  Synthetic sequence
caattgggctaccttttttttgttttgttggcaatggttaatctattgttaaaatttaaagtttcacttgaactttcaaataatgttcttatatttgcagtgtcgaaagaaacaaagtag

SEQ ID NO: 168 - DNA, 120 bp, Artificial sequence
  Synthetic sequence
caattgggctaccttttttttgttttgtttacaatggttaatctattgttaaaatttaaagtttcacttgaactttcaaataatgttcttatatttgcagtgtcgaaagaaacaaagtag

SEQ ID NO: 169 - DNA, 120 bp, Artificial sequence
  Synthetic sequence
caattgggctaccttttttttgttttgtttccaatggttaatctattgttaaaatttaaagtttcacttgaactttcaaataatgttcttatatttgcagtgtcgaaagaaacaaagtag

SEQ ID NO: 170 - DNA, 120 bp, Artificial sequence
  Synthetic sequence
caattgggctaccttttttttgttttgttttcaatggttaatctattgttaaaatttaaagtttcacttgaactttcaaataatgttcttatatttgcagtgtcgaaagaaacaaagtag

SEQ ID NO: 171 - DNA, 120 bp, Artificial sequence
  Synthetic sequence
caattgggctaccttttttttgttttgtttgaaatggttaatctattgttaaaatttaaagtttcacttgaactttcaaataatgttcttatatttgcagtgtcgaaagaaacaaagtag

SEQ ID NO: 172 - DNA, 120 bp, Artificial sequence
  Synthetic sequence
caattgggctaccttttttttgttttgtttggaatggttaatctattgttaaaatttaaagtttcacttgaactttcaaataatgttcttatatttgcagtgtcgaaagaaacaaagtag

SEQ ID NO: 173 - DNA, 120 bp, Artificial sequence
  Synthetic sequence
caattgggctaccttttttttgttttgtttgtaatggttaatctattgttaaaatttaaagtttcacttgaactttcaaataatgttcttatatttgcagtgtcgaaagaaacaaagtag

SEQ ID NO: 174 - DNA, 120 bp, Artificial sequence
  Synthetic sequence
caattgggctaccttttttttgttttgtttgccatggttaatctattgttaaaatttaaagtttcacttgaactttcaaataatgttcttatatttgcagtgtcgaaagaaacaaagtag

SEQ ID NO: 175 - DNA, 120 bp, Artificial sequence
  Synthetic sequence
caattgggctaccttttttttgttttgtttgcgatggttaatctattgttaaaatttaaagtttcacttgaactttcaaataatgttcttatatttgcagtgtcgaaagaaacaaagtag

SEQ ID NO: 176 - DNA, 120 bp, Artificial sequence
  Synthetic sequence
caattgggctaccttttttttgttttgtttgctatggttaatctattgttaaaatttaaagtttcacttgaactttcaaataatgttcttatatttgcagtgtcgaaagaaacaaagtag

SEQ ID NO: 177 - DNA, 120 bp, Artificial sequence
  Synthetic sequence
caattgggctaccttttttttgttttgtttgcactggttaatctattgttaaaatttaaagtttcacttgaactttcaaataatgttcttatatttgcagtgtcgaaagaaacaaagtag

SEQ ID NO: 178 - DNA, 120 bp, Artificial sequence
  Synthetic sequence
caattgggctaccttttttttgttttgtttgcagtggttaatctattgttaaaatttaaagtttcacttgaactttcaaataatgttcttatatttgcagtgtcgaaagaaacaaagtag

SEQ ID NO: 179 - DNA, 120 bp, Artificial sequence
  Synthetic sequence
caattgggctaccttttttttgttttgtttgcattggttaatctattgttaaaatttaaagtttcacttgaactttcaaataatgttcttatatttgcagtgtcgaaagaaacaaagtag

SEQ ID NO: 180 - DNA, 120 bp, Artificial sequence
  Synthetic sequence
caattgggctaccttttttttgttttgtttgcaaaggttaatctattgttaaaatttaaagtttcacttgaactttcaaataatgttcttatatttgcagtgtcgaaagaaacaaagtag

SEQ ID NO: 181 - DNA, 120 bp, Artificial sequence
  Synthetic sequence
caattgggctaccttttttttgttttgtttgcaacggttaatctattgttaaaatttaaagtttcacttgaactttcaaataatgttcttatatttgcagtgtcgaaagaaacaaagtag

SEQ ID NO: 182 - DNA, 120 bp, Artificial sequence
  Synthetic sequence
caattgggctaccttttttttgttttgtttgcaagggttaatctattgttaaaatttaaagtttcacttgaactttcaaataatgttcttatatttgcagtgtcgaaagaaacaaagtag

SEQ ID NO: 183 - DNA, 120 bp, Artificial sequence
  Synthetic sequence
caattgggctaccttttttttgttttgtttgcaatagttaatctattgttaaaatttaaagtttcacttgaactttcaaataatgttcttatatttgcagtgtcgaaagaaacaaagtag

SEQ ID NO: 184 - DNA, 120 bp, Artificial sequence
  Synthetic sequence
caattgggctaccttttttttgttttgtttgcaatcgttaatctattgttaaaatttaaagtttcacttgaactttcaaataatgttcttatatttgcagtgtcgaaagaaacaaagtag

SEQ ID NO: 185 - DNA, 120 bp, Artificial sequence
  Synthetic sequence
caattgggctaccttttttttgttttgtttgcaattgttaatctattgttaaaatttaaagtttcacttgaactttcaaataatgttcttatatttgcagtgtcgaaagaaacaaagtag

SEQ ID NO: 186 - DNA, 120 bp, Artificial sequence
  Synthetic sequence
caattgggctaccttttttttgttttgtttgcaatgattaatctattgttaaaatttaaagtttcacttgaactttcaaataatgttcttatatttgcagtgtcgaaagaaacaaagtag

SEQ ID NO: 187 - DNA, 120 bp, Artificial sequence
  Synthetic sequence
caattgggctaccttttttttgttttgtttgcaatgtttaatctattgttaaaatttaaagtttcacttgaactttcaaataatgttcttatatttgcagtgtcgaaagaaacaaagtag

SEQ ID NO: 188 - DNA, 120 bp, Artificial sequence
  Synthetic sequence
caattgggctaccttttttttgttttgtttgcaatggctaatctattgttaaaatttaaagtttcacttgaactttcaaataatgttcttatatttgcagtgtcgaaagaaacaaagtag

SEQ ID NO: 189 - DNA, 120 bp, Artificial sequence
  Synthetic sequence
caattgggctaccttttttttgttttgtttgcaatgggtaatctattgttaaaatttaaagtttcacttgaactttcaaataatgttcttatatttgcagtgtcgaaagaaacaaagtag

SEQ ID NO: 190 - DNA, 120 bp, Artificial sequence
  Synthetic sequence
caattgggctaccttttttttgttttgtttgcaatggtaaatctattgttaaaatttaaagtttcacttgaactttcaaataatgttcttatatttgcagtgtcgaaagaaacaaagtag

SEQ ID NO: 191 - DNA, 120 bp, Artificial sequence
  Synthetic sequence
caattgggctaccttttttttgttttgtttgcaatggtgaatctattgttaaaatttaaagtttcacttgaactttcaaataatgttcttatatttgcagtgtcgaaagaaacaaagtag

SEQ ID NO: 192 - DNA, 120 bp, Artificial sequence
  Synthetic sequence
caattgggctaccttttttttgttttgtttgcaatggttcatctattgttaaaatttaaagtttcacttgaactttcaaataatgttcttatatttgcagtgtcgaaagaaacaaagtag

SEQ ID NO: 193 - DNA, 120 bp, Artificial sequence
  Synthetic sequence
caattgggctaccttttttttgttttgtttgcaatggttgatctattgttaaaatttaaagtttcacttgaactttcaaataatgttcttatatttgcagtgtcgaaagaaacaaagtag

SEQ ID NO: 194 - DNA, 120 bp, Artificial sequence
  Synthetic sequence
caattgggctaccttttttttgttttgtttgcaatggtttatctattgttaaaatttaaagtttcacttgaactttcaaataatgttcttatatttgcagtgtcgaaagaaacaaagtag

SEQ ID NO: 195 - DNA, 120 bp, Artificial sequence
  Synthetic sequence
caattgggctaccttttttttgttttgtttgcaatggttactctattgttaaaatttaaagtttcacttgaactttcaaataatgttcttatatttgcagtgtcgaaagaaacaaagtag

SEQ ID NO: 196 - DNA, 120 bp, Artificial sequence
  Synthetic sequence
caattgggctaccttttttttgttttgtttgcaatggttagtctattgttaaaatttaaagtttcacttgaactttcaaataatgttcttatatttgcagtgtcgaaagaaacaaagtag

SEQ ID NO: 197 - DNA, 120 bp, Artificial sequence
  Synthetic sequence
caattgggctaccttttttttgttttgtttgcaatggttattctattgttaaaatttaaagtttcacttgaactttcaaataatgttcttatatttgcagtgtcgaaagaaacaaagtag

SEQ ID NO: 198 - DNA, 120 bp, Artificial sequence
  Synthetic sequence
caattgggctaccttttttttgttttgtttgcaatggttaaactattgttaaaatttaaagtttcacttgaactttcaaataatgttcttatatttgcagtgtcgaaagaaacaaagtag

SEQ ID NO: 199 - DNA, 120 bp, Artificial sequence
  Synthetic sequence
caattgggctaccttttttttgttttgtttgcaatggttaacctattgttaaaatttaaagtttcacttgaactttcaaataatgttcttatatttgcagtgtcgaaagaaacaaagtag

SEQ ID NO: 200 - DNA, 120 bp, Artificial sequence
  Synthetic sequence
caattgggctaccttttttttgttttgtttgcaatggttaagctattgttaaaatttaaagtttcacttgaactttcaaataatgttcttatatttgcagtgtcgaaagaaacaaagtag

SEQ ID NO: 201 - DNA, 120 bp, Artificial sequence
  Synthetic sequence
caattgggctaccttttttttgttttgtttgcaatggttaatatattgttaaaatttaaagtttcacttgaactttcaaataatgttcttatatttgcagtgtcgaaagaaacaaagtag

SEQ ID NO: 202 - DNA, 120 bp, Artificial sequence
  Synthetic sequence
caattgggctaccttttttttgttttgtttgcaatggttaatgtattgttaaaatttaaagtttcacttgaactttcaaataatgttcttatatttgcagtgtcgaaagaaacaaagtag

SEQ ID NO: 203 - DNA, 120 bp, Artificial sequence
  Synthetic sequence
caattgggctaccttttttttgttttgtttgcaatggttaatttattgttaaaatttaaagtttcacttgaactttcaaataatgttcttatatttgcagtgtcgaaagaaacaaagtag

SEQ ID NO: 204 - DNA, 120 bp, Artificial sequence
  Synthetic sequence
caattgggctaccttttttttgttttgtttgcaatggttaatcaattgttaaaatttaaagtttcacttgaactttcaaataatgttcttatatttgcagtgtcgaaagaaacaaagtag

SEQ ID NO: 205 - DNA, 120 bp, Artificial sequence
  Synthetic sequence
caattgggctaccttttttttgttttgtttgcaatggttaatccattgttaaaatttaaagtttcacttgaactttcaaataatgttcttatatttgcagtgtcgaaagaaacaaagtag

SEQ ID NO: 206 - DNA, 120 bp, Artificial sequence
  Synthetic sequence
caattgggctaccttttttttgttttgtttgcaatggttaatcgattgttaaaatttaaagtttcacttgaactttcaaataatgttcttatatttgcagtgtcgaaagaaacaaagtag

SEQ ID NO: 207 - DNA, 120 bp, Artificial sequence
  Synthetic sequence
caattgggctaccttttttttgttttgtttgcaatggttaatctcttgttaaaatttaaagtttcacttgaactttcaaataatgttcttatatttgcagtgtcgaaagaaacaaagtag

SEQ ID NO: 208 - DNA, 120 bp, Artificial sequence
  Synthetic sequence
caattgggctaccttttttttgttttgtttgcaatggttaatctgttgttaaaatttaaagtttcacttgaactttcaaataatgttcttatatttgcagtgtcgaaagaaacaaagtag

SEQ ID NO: 209 - DNA, 120 bp, Artificial sequence
  Synthetic sequence
caattgggctaccttttttttgttttgtttgcaatggttaatcttttgttaaaatttaaagtttcacttgaactttcaaataatgttcttatatttgcagtgtcgaaagaaacaaagtag

SEQ ID NO: 210 - DNA, 120 bp, Artificial sequence
  Synthetic sequence
caattgggctaccttttttttgttttgtttgcaatggttaatctaatgttaaaatttaaagtttcacttgaactttcaaataatgttcttatatttgcagtgtcgaaagaaacaaagtag

SEQ ID NO: 211 - DNA, 120 bp, Artificial sequence
  Synthetic sequence
caattgggctaccttttttttgttttgtttgcaatggttaatctactgttaaaatttaaagtttcacttgaactttcaaataatgttcttatatttgcagtgtcgaaagaaacaaagtag

SEQ ID NO: 212 - DNA, 120 bp, Artificial sequence
  Synthetic sequence
caattgggctaccttttttttgttttgtttgcaatggttaatctagtgttaaaatttaaagtttcacttgaactttcaaataatgttcttatatttgcagtgtcgaaagaaacaaagtag

SEQ ID NO: 213 - DNA, 120 bp, Artificial sequence
  Synthetic sequence
caattgggctaccttttttttgttttgtttgcaatggttaatctatagttaaaatttaaagtttcacttgaactttcaaataatgttcttatatttgcagtgtcgaaagaaacaaagtag

SEQ ID NO: 214 - DNA, 120 bp, Artificial sequence
  Synthetic sequence
caattgggctaccttttttttgttttgtttgcaatggttaatctatcgttaaaatttaaagtttcacttgaactttcaaataatgttcttatatttgcagtgtcgaaagaaacaaagtag

SEQ ID NO: 215 - DNA, 120 bp, Artificial sequence
  Synthetic sequence
caattgggctaccttttttttgttttgtttgcaatggttaatctatggttaaaatttaaagtttcacttgaactttcaaataatgttcttatatttgcagtgtcgaaagaaacaaagtag

SEQ ID NO: 216 - DNA, 120 bp, Artificial sequence
  Synthetic sequence
caattgggctaccttttttttgttttgtttgcaatggttaatctattattaaaatttaaagtttcacttgaactttcaaataatgttcttatatttgcagtgtcgaaagaaacaaagtag

SEQ ID NO: 217 - DNA, 120 bp, Artificial sequence
  Synthetic sequence
caattgggctaccttttttttgttttgtttgcaatggttaatctattcttaaaatttaaagtttcacttgaactttcaaataatgttcttatatttgcagtgtcgaaagaaacaaagtag

SEQ ID NO: 218 - DNA, 120 bp, Artificial sequence
  Synthetic sequence
caattgggctaccttttttttgttttgtttgcaatggttaatctatttttaaaatttaaagtttcacttgaactttcaaataatgttcttatatttgcagtgtcgaaagaaacaaagtag

SEQ ID NO: 219 - DNA, 120 bp, Artificial sequence
  Synthetic sequence
caattgggctaccttttttttgttttgtttgcaatggttaatctattgataaaatttaaagtttcacttgaactttcaaataatgttcttatatttgcagtgtcgaaagaaacaaagtag

SEQ ID NO: 220 - DNA, 120 bp, Artificial sequence
  Synthetic sequence
caattgggctaccttttttttgttttgtttgcaatggttaatctattgctaaaatttaaagtttcacttgaactttcaaataatgttcttatatttgcagtgtcgaaagaaacaaagtag

SEQ ID NO: 221 - DNA, 120 bp, Artificial sequence
  Synthetic sequence
caattgggctaccttttttttgttttgtttgcaatggttaatctattgtaaaaatttaaagtttcacttgaactttcaaataatgttcttatatttgcagtgtcgaaagaaacaaagtag

SEQ ID NO: 222 - DNA, 120 bp, Artificial sequence
  Synthetic sequence
caattgggctaccttttttttgttttgtttgcaatggttaatctattgtcaaaatttaaagtttcacttgaactttcaaataatgttcttatatttgcagtgtcgaaagaaacaaagtag

SEQ ID NO: 223 - DNA, 120 bp, Artificial sequence
  Synthetic sequence
caattgggctaccttttttttgttttgtttgcaatggttaatctattgtgaaaatttaaagtttcacttgaactttcaaataatgttcttatatttgcagtgtcgaaagaaacaaagtag

SEQ ID NO: 224 - DNA, 120 bp, Artificial sequence; identical to SEQ ID NO: 7
  Synthetic sequence

SEQ ID NO: 225 - DNA, 120 bp, Artificial sequence
  Synthetic sequence
caattgggctaccttttttttgttttgtttgcaatggttaatctattgtttaaatttaaagtttcacttgaactttcaaataatgttcttatatttgcagtgtcgaaagaaacaaagtag

SEQ ID NO: 226 - DNA, 120 bp, Artificial sequence
  Synthetic sequence
caattgggctaccttttttttgttttgtttgcaatggttaatctattgttacaatttaaagtttcacttgaactttcaaataatgttcttatatttgcagtgtcgaaagaaacaaagtag

SEQ ID NO: 227 - DNA, 120 bp, Artificial sequence
  Synthetic sequence
caattgggctaccttttttttgttttgtttgcaatggttaatctattgttagaatttaaagtttcacttgaactttcaaataatgttcttatatttgcagtgtcgaaagaaacaaagtag

SEQ ID NO: 228 - DNA, 120 bp, Artificial sequence
  Synthetic sequence
caattgggctaccttttttttgttttgtttgcaatggttaatctattgttataatttaaagtttcacttgaactttcaaataatgttcttatatttgcagtgtcgaaagaaacaaagtag

SEQ ID NO: 229 - DNA, 120 bp, Artificial sequence
  Synthetic sequence
caattgggctaccttttttttgttttgtttgcaatggttaatctattgttaacatttaaagtttcacttgaactttcaaataatgttcttatatttgcagtgtcgaaagaaacaaagtag

SEQ ID NO: 230 - DNA, 120 bp, Artificial sequence
  Synthetic sequence
caattgggctaccttttttttgttttgtttgcaatggttaatctattgttaagatttaaagtttcacttgaactttcaaataatgttcttatatttgcagtgtcgaaagaaacaaagtag

SEQ ID NO: 231 - DNA, 120 bp, Artificial sequence
  Synthetic sequence
caattgggctaccttttttttgttttgtttgcaatggttaatctattgttaatatttaaagtttcacttgaactttcaaataatgttcttatatttgcagtgtcgaaagaaacaaagtag

SEQ ID NO: 232 - DNA, 120 bp, Artificial sequence
  Synthetic sequence
caattgggctaccttttttttgttttgtttgcaatggttaatctattgttaaactttaaagtttcacttgaactttcaaataatgttcttatatttgcagtgtcgaaagaaacaaagtag

SEQ ID NO: 233 - DNA, 120 bp, Artificial sequence
  Synthetic sequence
caattgggctaccttttttttgttttgtttgcaatggttaatctattgttaaagtttaaagtttcacttgaactttcaaataatgttcttatatttgcagtgtcgaaagaaacaaagtag

SEQ ID NO: 234 - DNA, 120 bp, Artificial sequence
  Synthetic sequence
caattgggctaccttttttttgttttgtttgcaatggttaatctattgttaaattttaaagtttcacttgaactttcaaataatgttcttatatttgcagtgtcgaaagaaacaaagtag

SEQ ID NO: 235 - DNA, 120 bp, Artificial sequence
  Synthetic sequence
caattgggctaccttttttttgttttgtttgcaatggttaatctattgttaaaaattaaagtttcacttgaactttcaaataatgttcttatatttgcagtgtcgaaagaaacaaagtag

SEQ ID NO: 236 - DNA, 120 bp, Artificial sequence
  Synthetic sequence
caattgggctaccttttttttgttttgtttgcaatggttaatctattgttaaaacttaaagtttcacttgaactttcaaataatgttcttatatttgcagtgtcgaaagaaacaaagtag

SEQ ID NO: 237 - DNA, 120 bp, Artificial sequence
  Synthetic sequence
caattgggctaccttttttttgttttgtttgcaatggttaatctattgttaaaagttaaagtttcacttgaactttcaaataatgttcttatatttgcagtgtcgaaagaaacaaagtag

SEQ ID NO: 238 - DNA, 120 bp, Artificial sequence
  Synthetic sequence
caattgggctaccttttttttgttttgtttgcaatggttaatctattgttaaaatataaagtttcacttgaactttcaaataatgttcttatatttgcagtgtcgaaagaaacaaagtag

SEQ ID NO: 239 - DNA, 120 bp, Artificial sequence
  Synthetic sequence
caattgggctaccttttttttgttttgtttgcaatggttaatctattgttaaaatctaaagtttcacttgaactttcaaataatgttcttatatttgcagtgtcgaaagaaacaaagtag

SEQ ID NO: 240 - DNA, 120 bp, Artificial sequence
  Synthetic sequence
caattgggctaccttttttttgttttgtttgcaatggttaatctattgttaaaatgtaaagtttcacttgaactttcaaataatgttcttatatttgcagtgtcgaaagaaacaaagtag

SEQ ID NO: 241 - DNA, 120 bp, Artificial sequence
  Synthetic sequence
caattgggctaccttttttttgttttgtttgcaatggttaatctattgttaaaattaaaagtttcacttgaactttcaaataatgttcttatatttgcagtgtcgaaagaaacaaagtag

SEQ ID NO: 242 - DNA, 120 bp, Artificial sequence
  Synthetic sequence
caattgggctaccttttttttgttttgtttgcaatggttaatctattgttaaaattgaaagtttcacttgaactttcaaataatgttcttatatttgcagtgtcgaaagaaacaaagtag

SEQ ID NO: 243 - DNA, 120 bp, Artificial sequence
  Synthetic sequence
caattgggctaccttttttttgttttgtttgcaatggttaatctattgttaaaatttcaagtttcacttgaactttcaaataatgttcttatatttgcagtgtcgaaagaaacaaagtag

SEQ ID NO: 244 - DNA, 120 bp, Artificial sequence
  Synthetic sequence
caattgggctaccttttttttgttttgtttgcaatggttaatctattgttaaaatttgaagtttcacttgaactttcaaataatgttcttatatttgcagtgtcgaaagaaacaaagtag

SEQ ID NO: 245 - DNA, 120 bp, Artificial sequence
  Synthetic sequence
caattgggctaccttttttttgttttgtttgcaatggttaatctattgttaaaattttaagtttcacttgaactttcaaataatgttcttatatttgcagtgtcgaaagaaacaaagtag

SEQ ID NO: 246 - DNA, 120 bp, Artificial sequence
  Synthetic sequence
caattgggctaccttttttttgttttgtttgcaatggttaatctattgttaaaatttagagtttcacttgaactttcaaataatgttcttatatttgcagtgtcgaaagaaacaaagtag

SEQ ID NO: 247 - DNA, 120 bp, Artificial sequence
  Synthetic sequence
caattgggctaccttttttttgttttgtttgcaatggttaatctattgttaaaatttatagtttcacttgaactttcaaataatgttcttatatttgcagtgtcgaaagaaacaaagtag

SEQ ID NO: 248 - DNA, 120 bp, Artificial sequence
  Synthetic sequence
caattgggctaccttttttttgttttgtttgcaatggttaatctattgttaaaatttaacgtttcacttgaactttcaaataatgttcttatatttgcagtgtcgaaagaaacaaagtag

SEQ ID NO: 249 - DNA, 120 bp, Artificial sequence
  Synthetic sequence
caattgggctaccttttttttgttttgtttgcaatggttaatctattgttaaaatttaaggtttcacttgaactttcaaataatgttcttatatttgcagtgtcgaaagaaacaaagtag

SEQ ID NO: 250 - DNA, 120 bp, Artificial sequence
  Synthetic sequence
caattgggctaccttttttttgttttgtttgcaatggttaatctattgttaaaatttaatgtttcacttgaactttcaaataatgttcttatatttgcagtgtcgaaagaaacaaagtag

SEQ ID NO: 251 - DNA, 120 bp, Artificial sequence
  Synthetic sequence
caattgggctaccttttttttgttttgtttgcaatggttaatctattgttaaaatttaaaatttcacttgaactttcaaataatgttcttatatttgcagtgtcgaaagaaacaaagtag

SEQ ID NO: 252 - DNA, 120 bp, Artificial sequence
  Synthetic sequence
caattgggctaccttttttttgttttgtttgcaatggttaatctattgttaaaatttaaactttcacttgaactttcaaataatgttcttatatttgcagtgtcgaaagaaacaaagtag

SEQ ID NO: 253 - DNA, 120 bp, Artificial sequence
  Synthetic sequence
caattgggctaccttttttttgttttgtttgcaatggttaatctattgttaaaatttaaattttcacttgaactttcaaataatgttcttatatttgcagtgtcgaaagaaacaaagtag

SEQ ID NO: 254 - DNA, 120 bp, Artificial sequence
  Synthetic sequence
caattgggctaccttttttttgttttgtttgcaatggttaatctattgttaaaatttaaagattcacttgaactttcaaataatgttcttatatttgcagtgtcgaaagaaacaaagtag

SEQ ID NO: 255 - DNA, 120 bp, Artificial sequence
  Synthetic sequence
caattgggctaccttttttttgttttgtttgcaatggttaatctattgttaaaatttaaagcttcacttgaactttcaaataatgttcttatatttgcagtgtcgaaagaaacaaagtag

SEQ ID NO: 256 - DNA, 120 bp, Artificial sequence
  Synthetic sequence
caattgggctaccttttttttgttttgtttgcaatggttaatctattgttaaaatttaaaggttcacttgaactttcaaataatgttcttatatttgcagtgtcgaaagaaacaaagtag

SEQ ID NO: 257 - DNA, 120 bp, Artificial sequence
  Synthetic sequence
caattgggctaccttttttttgttttgtttgcaatggttaatctattgttaaaatttaaagtatcacttgaactttcaaataatgttcttatatttgcagtgtcgaaagaaacaaagtag

SEQ ID NO: 258 - DNA, 120 bp, Artificial sequence
  Synthetic sequence
caattgggctaccttttttttgttttgtttgcaatggttaatctattgttaaaatttaaagtctcacttgaactttcaaataatgttcttatatttgcagtgtcgaaagaaacaaagtag

SEQ ID NO: 259 - DNA, 120 bp, Artificial sequence
  Synthetic sequence
caattgggctaccttttttttgttttgtttgcaatggttaatctattgttaaaatttaaagtgtcacttgaactttcaaataatgttcttatatttgcagtgtcgaaagaaacaaagtag

SEQ ID NO: 260 - DNA, 120 bp, Artificial sequence
  Synthetic sequence
caattgggctaccttttttttgttttgtttgcaatggttaatctattgttaaaatttaaagttacacttgaactttcaaataatgttcttatatttgcagtgtcgaaagaaacaaagtag

SEQ ID NO: 261 - DNA, 120 bp, Artificial sequence
  Synthetic sequence
caattgggctaccttttttttgttttgtttgcaatggttaatctattgttaaaatttaaagttgcacttgaactttcaaataatgttcttatatttgcagtgtcgaaagaaacaaagtag

SEQ ID NO: 262 - DNA, 120 bp, Artificial sequence
  Synthetic sequence
caattgggctaccttttttttgttttgtttgcaatggttaatctattgttaaaatttaaagtttaacttgaactttcaaataatgttcttatatttgcagtgtcgaaagaaacaaagtag

SEQ ID NO: 263 - DNA, 120 bp, Artificial sequence
  Synthetic sequence
caattgggctaccttttttttgttttgtttgcaatggttaatctattgttaaaatttaaagtttgacttgaactttcaaataatgttcttatatttgcagtgtcgaaagaaacaaagtag

SEQ ID NO: 264 - DNA, 120 bp, Artificial sequence
  Synthetic sequence
caattgggctaccttttttttgttttgtttgcaatggttaatctattgttaaaatttaaagttttacttgaactttcaaataatgttcttatatttgcagtgtcgaaagaaacaaagtag

SEQ ID NO: 265 - DNA, 120 bp, Artificial sequence
  Synthetic sequence
caattgggctaccttttttttgttttgtttgcaatggttaatctattgttaaaatttaaagtttcgcttgaactttcaaataatgttcttatatttgcagtgtcgaaagaaacaaagtag

SEQ ID NO: 266 - DNA, 120 bp, Artificial sequence
  Synthetic sequence
caattgggctaccttttttttgttttgtttgcaatggttaatctattgttaaaatttaaagtttctcttgaactttcaaataatgttcttatatttgcagtgtcgaaagaaacaaagtag

SEQ ID NO: 267 - DNA, 120 bp, Artificial sequence
  Synthetic sequence
caattgggctaccttttttttgttttgtttgcaatggttaatctattgttaaaatttaaagtttcaattgaactttcaaataatgttcttatatttgcagtgtcgaaagaaacaaagtag

SEQ ID NO: 268 - DNA, 120 bp, Artificial sequence
  Synthetic sequence
caattgggctaccttttttttgttttgtttgcaatggttaatctattgttaaaatttaaagtttcagttgaactttcaaataatgttcttatatttgcagtgtcgaaagaaacaaagtag

SEQ ID NO: 269 - DNA, 120 bp, Artificial sequence
  Synthetic sequence
caattgggctaccttttttttgttttgtttgcaatggttaatctattgttaaaatttaaagtttcatttgaactttcaaataatgttcttatatttgcagtgtcgaaagaaacaaagtag

SEQ ID NO: 270 - DNA, 120 bp, Artificial sequence
  Synthetic sequence
caattgggctaccttttttttgttttgtttgcaatggttaatctattgttaaaatttaaagtttcacatgaactttcaaataatgttcttatatttgcagtgtcgaaagaaacaaagtag

SEQ ID NO: 271 - DNA, 120 bp, Artificial sequence
  Synthetic sequence
caattgggctaccttttttttgttttgtttgcaatggttaatctattgttaaaatttaaagtttcacctgaactttcaaataatgttcttatatttgcagtgtcgaaagaaacaaagtag

SEQ ID NO: 272 - DNA, 120 bp, Artificial sequence
  Synthetic sequence
caattgggctaccttttttttgttttgtttgcaatggttaatctattgttaaaatttaaagtttcacgtgaactttcaaataatgttcttatatttgcagtgtcgaaagaaacaaagtag

SEQ ID NO: 273 - DNA, 120 bp, Artificial sequence
  Synthetic sequence
caattgggctaccttttttttgttttgtttgcaatggttaatctattgttaaaatttaaagtttcactagaactttcaaataatgttcttatatttgcagtgtcgaaagaaacaaagtag

SEQ ID NO: 274 - DNA, 120 bp, Artificial sequence
  Synthetic sequence
caattgggctaccttttttttgttttgtttgcaatggttaatctattgttaaaatttaaagtttcactcgaactttcaaataatgttcttatatttgcagtgtcgaaagaaacaaagtag

SEQ ID NO: 275 - DNA, 120 bp, Artificial sequence
  Synthetic sequence
caattgggctaccttttttttgttttgtttgcaatggttaatctattgttaaaatttaaagtttcactggaactttcaaataatgttcttatatttgcagtgtcgaaagaaacaaagtag

SEQ ID NO: 276 - DNA, 120 bp, Artificial sequence
  Synthetic sequence
caattgggctaccttttttttgttttgtttgcaatggttaatctattgttaaaatttaaagtttcacttaaactttcaaataatgttcttatatttgcagtgtcgaaagaaacaaagtag

SEQ ID NO: 277 - DNA, 120 bp, Artificial sequence
  Synthetic sequence
caattgggctaccttttttttgttttgtttgcaatggttaatctattgttaaaatttaaagtttcacttcaactttcaaataatgttcttatatttgcagtgtcgaaagaaacaaagtag

SEQ ID NO: 278 - DNA, 120 bp, Artificial sequence
  Synthetic sequence
caattgggctaccttttttttgttttgtttgcaatggttaatctattgttaaaatttaaagtttcactttaactttcaaataatgttcttatatttgcagtgtcgaaagaaacaaagtag

SEQ ID NO: 279 - DNA, 120 bp, Artificial sequence
  Synthetic sequence
caattgggctaccttttttttgttttgtttgcaatggttaatctattgttaaaatttaaagtttcacttgcactttcaaataatgttcttatatttgcagtgtcgaaagaaacaaagtag

SEQ ID NO: 280 - DNA, 120 bp, Artificial sequence
  Synthetic sequence
caattgggctaccttttttttgttttgtttgcaatggttaatctattgttaaaatttaaagtttcacttggactttcaaataatgttcttatatttgcagtgtcgaaagaaacaaagtag

SEQ ID NO: 281 - DNA, 120 bp, Artificial sequence
  Synthetic sequence
caattgggctaccttttttttgttttgtttgcaatggttaatctattgttaaaatttaaagtttcacttgtactttcaaataatgttcttatatttgcagtgtcgaaagaaacaaagtag

SEQ ID NO: 282 - DNA, 120 bp, Artificial sequence
  Synthetic sequence
caattgggctaccttttttttgttttgtttgcaatggttaatctattgttaaaatttaaagtttcacttgacctttcaaataatgttcttatatttgcagtgtcgaaagaaacaaagtag

SEQ ID NO: 283 - DNA, 120 bp, Artificial sequence
  Synthetic sequence
caattgggctaccttttttttgttttgtttgcaatggttaatctattgttaaaatttaaagtttcacttgagctttcaaataatgttcttatatttgcagtgtcgaaagaaacaaagtag

SEQ ID NO: 284 - DNA, 120 bp, Artificial sequence
  Synthetic sequence
caattgggctaccttttttttgttttgtttgcaatggttaatctattgttaaaatttaaagtttcacttgatctttcaaataatgttcttatatttgcagtgtcgaaagaaacaaagtag

SEQ ID NO: 285 - DNA, 120 bp, Artificial sequence
  Synthetic sequence
caattgggctaccttttttttgttttgtttgcaatggttaatctattgttaaaatttaaagtttcacttgaaatttcaaataatgttcttatatttgcagtgtcgaaagaaacaaagtag

SEQ ID NO: 286 - DNA, 120 bp, Artificial sequence
  Synthetic sequence
caattgggctaccttttttttgttttgtttgcaatggttaatctattgttaaaatttaaagtttcacttgaagtttcaaataatgttcttatatttgcagtgtcgaaagaaacaaagtag

SEQ ID NO: 287 - DNA, 120 bp, Artificial sequence
  Synthetic sequence
caattgggctaccttttttttgttttgtttgcaatggttaatctattgttaaaatttaaagtttcacttgaattttcaaataatgttcttatatttgcagtgtcgaaagaaacaaagtag

SEQ ID NO: 288 - DNA, 120 bp, Artificial sequence
  Synthetic sequence
caattgggctaccttttttttgttttgtttgcaatggttaatctattgttaaaatttaaagtttcacttgaacattcaaataatgttcttatatttgcagtgtcgaaagaaacaaagtag

SEQ ID NO: 289 - DNA, 120 bp, Artificial sequence
  Synthetic sequence
caattgggctaccttttttttgttttgtttgcaatggttaatctattgttaaaatttaaagtttcacttgaaccttcaaataatgttcttatatttgcagtgtcgaaagaaacaaagtag

SEQ ID NO: 290 - DNA, 120 bp, Artificial sequence
  Synthetic sequence
caattgggctaccttttttttgttttgtttgcaatggttaatctattgttaaaatttaaagtttcacttgaacgttcaaataatgttcttatatttgcagtgtcgaaagaaacaaagtag

SEQ ID NO: 291 - DNA, 120 bp, Artificial sequence
  Synthetic sequence
caattgggctaccttttttttgttttgtttgcaatggttaatctattgttaaaatttaaagtttcacttgaactatcaaataatgttcttatatttgcagtgtcgaaagaaacaaagtag

SEQ ID NO: 292 - DNA, 120 bp, Artificial sequence
  Synthetic sequence
caattgggctaccttttttttgttttgtttgcaatggttaatctattgttaaaatttaaagtttcacttgaactctcaaataatgttcttatatttgcagtgtcgaaagaaacaaagtag

SEQ ID NO: 293 - DNA, 120 bp, Artificial sequence
  Synthetic sequence
caattgggctaccttttttttgttttgtttgcaatggttaatctattgttaaaatttaaagtttcacttgaactgtcaaataatgttcttatatttgcagtgtcgaaagaaacaaagtag

SEQ ID NO: 294 - DNA, 120 bp, Artificial sequence
  Synthetic sequence
caattgggctaccttttttttgttttgtttgcaatggttaatctattgttaaaatttaaagtttcacttgaacttacaaataatgttcttatatttgcagtgtcgaaagaaacaaagtag

SEQ ID NO: 295 - DNA, 120 bp, Artificial sequence
  Synthetic sequence
caattgggctaccttttttttgttttgtttgcaatggttaatctattgttaaaatttaaagtttcacttgaacttccaaataatgttcttatatttgcagtgtcgaaagaaacaaagtag

SEQ ID NO: 296 - DNA, 120 bp, Artificial sequence
  Synthetic sequence
caattgggctaccttttttttgttttgtttgcaatggttaatctattgttaaaatttaaagtttcacttgaacttgcaaataatgttcttatatttgcagtgtcgaaagaaacaaagtag

SEQ ID NO: 297 - DNA, 120 bp, Artificial sequence
  Synthetic sequence
caattgggctaccttttttttgttttgtttgcaatggttaatctattgttaaaatttaaagtttcacttgaactttaaaataatgttcttatatttgcagtgtcgaaagaaacaaagtag

SEQ ID NO: 298 - DNA, 120 bp, Artificial sequence
  Synthetic sequence
caattgggctaccttttttttgttttgtttgcaatggttaatctattgttaaaatttaaagtttcacttgaactttgaaataatgttcttatatttgcagtgtcgaaagaaacaaagtag

SEQ ID NO: 299 - DNA, 120 bp, Artificial sequence
  Synthetic sequence
caattgggctaccttttttttgttttgtttgcaatggttaatctattgttaaaatttaaagtttcacttgaacttttaaataatgttcttatatttgcagtgtcgaaagaaacaaagtag

SEQ ID NO: 300 - DNA, 120 bp, Artificial sequence
  Synthetic sequence
caattgggctaccttttttttgttttgtttgcaatggttaatctattgttaaaatttaaagtttcacttgaactttccaataatgttcttatatttgcagtgtcgaaagaaacaaagtag

SEQ ID NO: 301 - DNA, 120 bp, Artificial sequence
  Synthetic sequence
caattgggctaccttttttttgttttgtttgcaatggttaatctattgttaaaatttaaagtttcacttgaactttcgaataatgttcttatatttgcagtgtcgaaagaaacaaagtag

SEQ ID NO: 302 - DNA, 120 bp, Artificial sequence
  Synthetic sequence
caattgggctaccttttttttgttttgtttgcaatggttaatctattgttaaaatttaaagtttcacttgaactttctaataatgttcttatatttgcagtgtcgaaagaaacaaagtag

SEQ ID NO: 303 - DNA, 120 bp, Artificial sequence
  Synthetic sequence
caattgggctaccttttttttgttttgtttgcaatggttaatctattgttaaaatttaaagtttcacttgaactttcacataatgttcttatatttgcagtgtcgaaagaaacaaagtag

SEQ ID NO: 304 - DNA, 120 bp, Artificial sequence
  Synthetic sequence
caattgggctaccttttttttgttttgtttgcaatggttaatctattgttaaaatttaaagtttcacttgaactttcagataatgttcttatatttgcagtgtcgaaagaaacaaagtag

SEQ ID NO: 305 - DNA, 120 bp, Artificial sequence
  Synthetic sequence
caattgggctaccttttttttgttttgtttgcaatggttaatctattgttaaaatttaaagtttcacttgaactttcatataatgttcttatatttgcagtgtcgaaagaaacaaagtag

SEQ ID NO: 306 - DNA, 120 bp, Artificial sequence
  Synthetic sequence
caattgggctaccttttttttgttttgtttgcaatggttaatctattgttaaaatttaaagtttcacttgaactttcaactaatgttcttatatttgcagtgtcgaaagaaacaaagtag

SEQ ID NO: 307 - DNA, 120 bp, Artificial sequence
  Synthetic sequence
caattgggctaccttttttttgttttgtttgcaatggttaatctattgttaaaatttaaagtttcacttgaactttcaagtaatgttcttatatttgcagtgtcgaaagaaacaaagtag

SEQ ID NO: 308 - DNA, 120 bp, Artificial sequence
  Synthetic sequence
caattgggctaccttttttttgttttgtttgcaatggttaatctattgttaaaatttaaagtttcacttgaactttcaattaatgttcttatatttgcagtgtcgaaagaaacaaagtag

SEQ ID NO: 309 - DNA, 120 bp, Artificial sequence
  Synthetic sequence
caattgggctaccttttttttgttttgtttgcaatggttaatctattgttaaaatttaaagtttcacttgaactttcaaaaaatgttcttatatttgcagtgtcgaaagaaacaaagtag

SEQ ID NO: 310 - DNA, 120 bp, Artificial sequence
  Synthetic sequence
caattgggctaccttttttttgttttgtttgcaatggttaatctattgttaaaatttaaagtttcacttgaactttcaaagaatgttcttatatttgcagtgtcgaaagaaacaaagtag

SEQ ID NO: 311 - DNA, 120 bp, Artificial sequence
  Synthetic sequence
caattgggctaccttttttttgttttgtttgcaatggttaatctattgttaaaatttaaagtttcacttgaactttcaaatcatgttcttatatttgcagtgtcgaaagaaacaaagtag

SEQ ID NO: 312 - DNA, 120 bp, Artificial sequence
  Synthetic sequence
caattgggctaccttttttttgttttgtttgcaatggttaatctattgttaaaatttaaagtttcacttgaactttcaaatgatgttcttatatttgcagtgtcgaaagaaacaaagtag

SEQ ID NO: 313 - DNA, 120 bp, Artificial sequence
  Synthetic sequence
caattgggctaccttttttttgttttgtttgcaatggttaatctattgttaaaatttaaagtttcacttgaactttcaaattatgttcttatatttgcagtgtcgaaagaaacaaagtag

SEQ ID NO: 314 - DNA, 120 bp, Artificial sequence
  Synthetic sequence
caattgggctaccttttttttgttttgtttgcaatggttaatctattgttaaaatttaaagtttcacttgaactttcaaatactgttcttatatttgcagtgtcgaaagaaacaaagtag

SEQ ID NO: 315 - DNA, 120 bp, Artificial sequence
  Synthetic sequence
caattgggctaccttttttttgttttgtttgcaatggttaatctattgttaaaatttaaagtttcacttgaactttcaaatagtgttcttatatttgcagtgtcgaaagaaacaaagtag

SEQ ID NO: 316 - DNA, 120 bp, Artificial sequence
  Synthetic sequence
caattgggctaccttttttttgttttgtttgcaatggttaatctattgttaaaatttaaagtttcacttgaactttcaaatattgttcttatatttgcagtgtcgaaagaaacaaagtag

SEQ ID NO: 317 - DNA, 120 bp, Artificial sequence
  Synthetic sequence
caattgggctaccttttttttgttttgtttgcaatggttaatctattgttaaaatttaaagtttcacttgaactttcaaataaagttcttatatttgcagtgtcgaaagaaacaaagtag

SEQ ID NO: 318 - DNA, 120 bp, Artificial sequence
  Synthetic sequence
caattgggctaccttttttttgttttgtttgcaatggttaatctattgttaaaatttaaagtttcacttgaactttcaaataacgttcttatatttgcagtgtcgaaagaaacaaagtag

SEQ ID NO: 319 - DNA, 120 bp, Artificial sequence
  Synthetic sequence
caattgggctaccttttttttgttttgtttgcaatggttaatctattgttaaaatttaaagtttcacttgaactttcaaataaggttcttatatttgcagtgtcgaaagaaacaaagtag

SEQ ID NO: 320 - DNA, 120 bp, Artificial sequence
  Synthetic sequence
caattgggctaccttttttttgttttgtttgcaatggttaatctattgttaaaatttaaagtttcacttgaactttcaaataatattcttatatttgcagtgtcgaaagaaacaaagtag

SEQ ID NO: 321 - DNA, 120 bp, Artificial sequence
  Synthetic sequence
caattgggctaccttttttttgttttgtttgcaatggttaatctattgttaaaatttaaagtttcacttgaactttcaaataatcttcttatatttgcagtgtcgaaagaaacaaagtag

SEQ ID NO: 322 - DNA, 120 bp, Artificial sequence
  Synthetic sequence
caattgggctaccttttttttgttttgtttgcaatggttaatctattgttaaaatttaaagtttcacttgaactttcaaataattttcttatatttgcagtgtcgaaagaaacaaagtag

SEQ ID NO: 323 - DNA, 120 bp, Artificial sequence
  Synthetic sequence
caattgggctaccttttttttgttttgtttgcaatggttaatctattgttaaaatttaaagtttcacttgaactttcaaataatgatcttatatttgcagtgtcgaaagaaacaaagtag

SEQ ID NO: 324 - DNA, 120 bp, Artificial sequence
  Synthetic sequence
caattgggctaccttttttttgttttgtttgcaatggttaatctattgttaaaatttaaagtttcacttgaactttcaaataatgctcttatatttgcagtgtcgaaagaaacaaagtag

SEQ ID NO: 325 - DNA, 120 bp, Artificial sequence
  Synthetic sequence
caattgggctaccttttttttgttttgtttgcaatggttaatctattgttaaaatttaaagtttcacttgaactttcaaataatggtcttatatttgcagtgtcgaaagaaacaaagtag

SEQ ID NO: 326 - DNA, 120 bp, Artificial sequence
  Synthetic sequence
caattgggctaccttttttttgttttgtttgcaatggttaatctattgttaaaatttaaagtttcacttgaactttcaaataatgtacttatatttgcagtgtcgaaagaaacaaagtag

SEQ ID NO: 327 - DNA, 120 bp, Artificial sequence
  Synthetic sequence
caattgggctaccttttttttgttttgtttgcaatggttaatctattgttaaaatttaaagtttcacttgaactttcaaataatgtccttatatttgcagtgtcgaaagaaacaaagtag

SEQ ID NO: 328 - DNA, 120 bp, Artificial sequence
  Synthetic sequence
caattgggctaccttttttttgttttgtttgcaatggttaatctattgttaaaatttaaagtttcacttgaactttcaaataatgtgcttatatttgcagtgtcgaaagaaacaaagtag

SEQ ID NO: 329 - DNA, 120 bp, Artificial sequence
  Synthetic sequence
caattgggctaccttttttttgttttgtttgcaatggttaatctattgttaaaatttaaagtttcacttgaactttcaaataatgttattatatttgcagtgtcgaaagaaacaaagtag

SEQ ID NO: 330 - DNA, 120 bp, Artificial sequence
  Synthetic sequence
caattgggctaccttttttttgttttgtttgcaatggttaatctattgttaaaatttaaagtttcacttgaactttcaaataatgttgttatatttgcagtgtcgaaagaaacaaagtag

SEQ ID NO: 331 - DNA, 120 bp, Artificial sequence
  Synthetic sequence
caattgggctaccttttttttgttttgtttgcaatggttaatctattgttaaaatttaaagtttcacttgaactttcaaataatgtttttatatttgcagtgtcgaaagaaacaaagtag

SEQ ID NO: 332 - DNA, 120 bp, Artificial sequence
  Synthetic sequence
caattgggctaccttttttttgttttgtttgcaatggttaatctattgttaaaatttaaagtttcacttgaactttcaaataatgttcatatatttgcagtgtcgaaagaaacaaagtag

SEQ ID NO: 333 - DNA, 120 bp, Artificial sequence
  Synthetic sequence
caattgggctaccttttttttgttttgtttgcaatggttaatctattgttaaaatttaaagtttcacttgaactttcaaataatgttcctatatttgcagtgtcgaaagaaacaaagtag

SEQ ID NO: 334 - DNA, 120 bp, Artificial sequence
  Synthetic sequence
caattgggctaccttttttttgttttgtttgcaatggttaatctattgttaaaatttaaagtttcacttgaactttcaaataatgttcgtatatttgcagtgtcgaaagaaacaaagtag

SEQ ID NO: 335 - DNA, 120 bp, Artificial sequence
  Synthetic sequence
caattgggctaccttttttttgttttgtttgcaatggttaatctattgttaaaatttaaagtttcacttgaactttcaaataatgttctaatatttgcagtgtcgaaagaaacaaagtag

SEQ ID NO: 336 - DNA, 120 bp, Artificial sequence
  Synthetic sequence
caattgggctaccttttttttgttttgtttgcaatggttaatctattgttaaaatttaaagtttcacttgaactttcaaataatgttctcatatttgcagtgtcgaaagaaacaaagtag

SEQ ID NO: 337 - DNA, 120 bp, Artificial sequence
  Synthetic sequence
caattgggctaccttttttttgttttgtttgcaatggttaatctattgttaaaatttaaagtttcacttgaactttcaaataatgttctgatatttgcagtgtcgaaagaaacaaagtag

SEQ ID NO: 338 - DNA, 120 bp, Artificial sequence; identical to SEQ ID NO: 5
  Synthetic sequence

SEQ ID NO: 339 - DNA, 120 bp, Artificial sequence
  Synthetic sequence
caattgggctaccttttttttgttttgtttgcaatggttaatctattgttaaaatttaaagtttcacttgaactttcaaataatgttcttgtatttgcagtgtcgaaagaaacaaagtag

SEQ ID NO: 340 - DNA, 120 bp, Artificial sequence
  Synthetic sequence
caattgggctaccttttttttgttttgtttgcaatggttaatctattgttaaaatttaaagtttcacttgaactttcaaataatgttcttttatttgcagtgtcgaaagaaacaaagtag

SEQ ID NO: 341 - DNA, 120 bp, Artificial sequence
  Synthetic sequence
caattgggctaccttttttttgttttgtttgcaatggttaatctattgttaaaatttaaagtttcacttgaactttcaaataatgttcttaaatttgcagtgtcgaaagaaacaaagtag

SEQ ID NO: 342 - DNA, 120 bp, Artificial sequence
  Synthetic sequence
caattgggctaccttttttttgttttgtttgcaatggttaatctattgttaaaatttaaagtttcacttgaactttcaaataatgttcttacatttgcagtgtcgaaagaaacaaagtag

SEQ ID NO: 343 - DNA, 120 bp, Artificial sequence
  Synthetic sequence
caattgggctaccttttttttgttttgtttgcaatggttaatctattgttaaaatttaaagtttcacttgaactttcaaataatgttcttagatttgcagtgtcgaaagaaacaaagtag

SEQ ID NO: 344 - DNA, 120 bp, Artificial sequence
  Synthetic sequence
caattgggctaccttttttttgttttgtttgcaatggttaatctattgttaaaatttaaagtttcacttgaactttcaaataatgttcttatctttgcagtgtcgaaagaaacaaagtag

SEQ ID NO: 345 - DNA, 120 bp, Artificial sequence
  Synthetic sequence
caattgggctaccttttttttgttttgtttgcaatggttaatctattgttaaaatttaaagtttcacttgaactttcaaataatgttcttatgtttgcagtgtcgaaagaaacaaagtag

SEQ ID NO: 346 - DNA, 120 bp, Artificial sequence
  Synthetic sequence
caattgggctaccttttttttgttttgtttgcaatggttaatctattgttaaaatttaaagtttcacttgaactttcaaataatgttcttatttttgcagtgtcgaaagaaacaaagtag

SEQ ID NO: 347 - DNA, 120 bp, Artificial sequence
  Synthetic sequence
caattgggctaccttttttttgttttgtttgcaatggttaatctattgttaaaatttaaagtttcacttgaactttcaaataatgttcttataattgcagtgtcgaaagaaacaaagtag

SEQ ID NO: 348 - DNA, 120 bp, Artificial sequence
  Synthetic sequence
caattgggctaccttttttttgttttgtttgcaatggttaatctattgttaaaatttaaagtttcacttgaactttcaaataatgttcttatacttgcagtgtcgaaagaaacaaagtag

SEQ ID NO: 349 - DNA, 120 bp, Artificial sequence
  Synthetic sequence
caattgggctaccttttttttgttttgtttgcaatggttaatctattgttaaaatttaaagtttcacttgaactttcaaataatgttcttatatatgcagtgtcgaaagaaacaaagtag

SEQ ID NO: 350 - DNA, 120 bp, Artificial sequence
  Synthetic sequence
caattgggctaccttttttttgttttgtttgcaatggttaatctattgttaaaatttaaagtttcacttgaactttcaaataatgttcttatatctgcagtgtcgaaagaaacaaagtag

SEQ ID NO: 351 - DNA, 120 bp, Artificial sequence; identical to SEQ ID NO: 3
  Synthetic sequence

SEQ ID NO: 352 - DNA, 120 bp, Artificial sequence
  Synthetic sequence
caattgggctaccttttttttgttttgtttgcaatggttaatctattgttaaaatttaaagtttcacttgaactttcaaataatgttcttatattagcagtgtcgaaagaaacaaagtag

SEQ ID NO: 353 - DNA, 120 bp, Artificial sequence
  Synthetic sequence
caattgggctaccttttttttgttttgtttgcaatggttaatctattgttaaaatttaaagtttcacttgaactttcaaataatgttcttatattggcagtgtcgaaagaaacaaagtag

SEQ ID NO: 354 - DNA, 120 bp, Artificial sequence
  Synthetic sequence
caattgggctaccttttttttgttttgtttgcaatggttaatctattgttaaaatttaaagtttcacttgaactttcaaataatgttcttatatttacagtgtcgaaagaaacaaagtag

SEQ ID NO: 355 - DNA, 120 bp, Artificial sequence; identical to SEQ ID NO: 6
  Synthetic sequence

SEQ ID NO: 356 - DNA, 120 bp, Artificial sequence
  Synthetic sequence
caattgggctaccttttttttgttttgtttgcaatggttaatctattgttaaaatttaaagtttcacttgaactttcaaataatgttcttatattttcagtgtcgaaagaaacaaagtag

SEQ ID NO: 357 - DNA, 120 bp, Artificial sequence
  Synthetic sequence
caattgggctaccttttttttgttttgtttgcaatggttaatctattgttaaaatttaaagtttcacttgaactttcaaataatgttcttatatttggagtgtcgaaagaaacaaagtag

SEQ ID NO: 358 - DNA, 120 bp, Artificial sequence
  Synthetic sequence
caattgggctaccttttttttgttttgtttgcaatggttaatctattgttaaaatttaaagtttcacttgaactttcaaataatgttcttatatttgtagtgtcgaaagaaacaaagtag

SEQ ID NO: 359 - DNA, 120 bp, Artificial sequence
  Synthetic sequence
caattgggctaccttttttttgttttgtttgcaatggttaatctattgttaaaatttaaagtttcacttgaactttcaaataatgttcttatatttgccgtgtcgaaagaaacaaagtag

SEQ ID NO: 360 - DNA, 120 bp, Artificial sequence
  Synthetic sequence
caattgggctaccttttttttgttttgtttgcaatggttaatctattgttaaaatttaaagtttcacttgaactttcaaataatgttcttatatttgcggtgtcgaaagaaacaaagtag

SEQ ID NO: 361 - DNA, 120 bp, Artificial sequence
  Synthetic sequence
caattgggctaccttttttttgttttgtttgcaatggttaatctattgttaaaatttaaagtttcacttgaactttcaaataatgttcttatatttgctgtgtcgaaagaaacaaagtag

SEQ ID NO: 362 - DNA, 120 bp, Artificial sequence
  Synthetic sequence
caattgggctaccttttttttgttttgtttgcaatggttaatctattgttaaaatttaaagtttcacttgaactttcaaataatgttcttatatttgcaatgtcgaaagaaacaaagtag

SEQ ID NO: 363 - DNA, 120 bp, Artificial sequence
  Synthetic sequence
caattgggctaccttttttttgttttgtttgcaatggttaatctattgttaaaatttaaagtttcacttgaactttcaaataatgttcttatatttgcactgtcgaaagaaacaaagtag

SEQ ID NO: 364 - DNA, 120 bp, Artificial sequence
  Synthetic sequence
caattgggctaccttttttttgttttgtttgcaatggttaatctattgttaaaatttaaagtttcacttgaactttcaaataatgttcttatatttgcattgtcgaaagaaacaaagtag

SEQ ID NO: 365 - DNA, 32 bp, Artificial sequence
  Synthetic sequence
  misc_feature (9)..(28): n is a, c, g, or t
gactgatcnnnnnnnnnnnnnnnnnnnncgta

SEQ ID NO: 366 - DNA, 32 bp, Artificial sequence
  Synthetic sequence
  misc_feature (9)..(28): n is a, c, g, or t
catttacgnnnnnnnnnnnnnnnnnnnngatc

SEQ ID NO: 367 - DNA, 32 bp, Artificial sequence
  Synthetic sequence
  misc_feature (9)..(19): n is a, c, g, or t
  misc_feature (27)..(28): n is a, c, g, or t
gactgatcnnnnnnnnnnnrrrrrrrnncgta

SEQ ID NO: 368 - DNA, 32 bp, Artificial sequence
  Synthetic sequence
  misc_feature (9)..(10): n is a, c, g, or t
  misc_feature (18)..(28): n is a, c, g, or t
catttacgnnyyyyyyynnnnnnnnnnngatc

SEQ ID NO: 369 - DNA, 32 bp, Artificial sequence
  Synthetic sequence
  misc_feature (9)..(17): n is a, c, g, or t
  misc_feature (29)..(29): n is a, c, g, or t
gactgatcnnnnnnnnnwwwaaawwtwanaat

SEQ ID NO: 370 - DNA, 32 bp, Artificial sequence
  Synthetic sequence
  misc_feature (8)..(8): n is a, c, g, or t
  misc_feature (20)..(28): n is a, c, g, or t
cattattntwawwtttwwwnnnnnnnnngatc

SEQ ID NO: 371 - DNA, 15 bp, Artificial sequence
  Synthetic sequence
  misc_feature (1)..(1): n is a, c, g, or t
  misc_feature (8)..(8): n is a, c, g, or t
nwawtwanaataatg

SEQ ID NO: 372 - DNA, 11 bp, Artificial sequence
  Synthetic sequence
  misc_feature (3)..(4): n is a, c, g, or t
  misc_feature (9)..(11): n is a, c, g, or t
tanntttgnnn

SEQ ID NO: 373 - DNA, 28 bp, Artificial sequence
  Synthetic sequence
  misc_feature (1)..(11): n is a, c, g, or t
  misc_feature (19)..(20): n is a, c, g, or t
nnnnnnnnnnnrrrrrrrnncgtaaatg

SEQ ID NO: 374 - DNA, 28 bp, Artificial sequence
  Synthetic sequence
  misc_feature (1)..(20): n is a, c, g, or t
nnnnnnnnnnnnnnnnnnnncgtaaatg

SEQ ID NO: 375 - DNA, 28 bp, Artificial sequence
  Synthetic sequence
  misc_feature (1)..(9): n is a, c, g, or t
  misc_feature (21)..(21): n is a, c, g, or t
nnnnnnnnnwwwaaawwtwanaataatg

SEQ ID NO: 376 - DNA, 20 bp, Artificial sequence
  Synthetic sequence
tggtgttcagtgctttgctc

SEQ ID NO: 377 - DNA, 20 bp, Artificial sequence
  Synthetic sequence
agctcaatgcggtttaccag

SEQ ID NO: 378 - DNA, 20 bp, Artificial sequence
  Synthetic sequence
cgttccattaggcagttggt

SEQ ID NO: 379 - DNA, 20 bp, Artificial sequence
  Synthetic sequence
caacccatagggcagtcatc

SEQ ID NO: 380 - DNA, 17 bp, Artificial sequence
  Synthetic sequence
aaaaaaaaaaaaaaaaa

SEQ ID NO: 381 - DNA, 91 bp, Artificial sequence
  Synthetic sequence
aaaaaaccccgcccctgacagggcggggttttttttttcacttgaactttcaaataatgttcttataaaaccagtgtcgaaagaaacaaag

SEQ ID NO: 382 - DNA, 91 bp, Artificial sequence
  Synthetic sequence
aaaaaaccccgcccctgacagggcggggttttttttttcacttgaactttcaaataatgttcttatatatgcagtgtcgaaagaaacaaag

SEQ ID NO: 383 - DNA, 91 bp, Artificial sequence
  Synthetic sequence
gtttgcaatggttaatctattgttaaaatttaaagtttcacttgaactttcaaataatgttcttatatgtgcagtgtcgaaagaaacaaag

SEQ ID NO: 384 - DNA, 91 bp, Artificial sequence
  Synthetic sequence
gtttgcaatggttaatctattgttaacatttaaagtttcacttgaactttcaaataatgttcttatattttcagtgtcgaaagaaacaaag

SEQ ID NO: 385 - DNA, 91 bp, Artificial sequence
  Synthetic sequence
gtttgcaatggttaatctattgttaaaatttaaagtttcacttgaactttcaaataatgttcttctatttgcagtgtcgaaagaaacaaag

SEQ ID NO: 386 - DNA, 91 bp, Artificial sequence
  Synthetic sequence
gtttgcaatggttaatctattgttaaaatttaaagtttcacttgaactttcaaataatgttcttatatttccagtgtcgaaagaaacaaag

SEQ ID NO: 387 - DNA, 91 bp, Artificial sequence
  Synthetic sequence
gtttgcaatggttaatctattgttgaaatttaaagtttcacttgaactttcaaataatgttcttatatttgcagtgtcgaaagaaacaaag

SEQ ID NO: 388 - DNA, 91 bp, Artificial sequence
  Synthetic sequence
gtttgcaatggttaatctattgttaaaatttaaagtttcacttgaactttcaaataatgttcttatatttgcagtgtcgaaagaaacaaag

SEQ ID NO: 389 - DNA, 55 bp, Artificial sequence
  Synthetic sequence
tgttaaaatttaaagtttcacttgaactttcaaataatgttcttatatttgcagt

SEQ ID NO: 390 - DNA, 57 bp, Artificial sequence
  Synthetic sequence
attgttaaaatttaaagtttcacttgaactttcaaataatgttcttatatttgcagt

SEQ ID NO: 391 - DNA, 63 bp, Artificial sequence
  Synthetic sequence
tttaaagtttcacttgaactttcaaataatgttcttatatttgcagtgtcgaaagaaacaaag

SEQ ID NO: 392 - DNA, 73 bp, Artificial sequence
  Synthetic sequence
attgttaaaatttaaagtttcacttgaactttcaaataatgttcttatatttgcagtgtcgaaagaaacaaag

SEQ ID NO: 393 - DNA, 75 bp, Artificial sequence
  Synthetic sequence
gtttgcaatggttaatctattgttaaaatttaaagtttcacttgaactttcaaataatgttcttatatttgcagt

SEQ ID NO: 394 - DNA, 114 bp, Artificial sequence
  Synthetic sequence
gactaccttttttttgttttgtttgcaatggttaatctattgttaaaatttaaagtttcacttgaactttcaaataatgttcttatatttgcagtgtcgaaagaaacaaagtag

SEQ ID NO: 395 - DNA, 60 bp, Artificial sequence
  Synthetic sequence
gtttcacttgaactttcaaataatgttcttatatttgcagtgtcgaaagaaacaaagtag

SEQ ID NO: 396 - DNA, 80 bp, Artificial sequence
  Synthetic sequence
atctattgttaaaatttaaagtttcacttgaactttcaaataatgttcttatatttgcagtgtcgaaagaaacaaagtag

SEQ ID NO: 397 - DNA, 100 bp, Artificial sequence
  Synthetic sequence
tgttttgtttgcaatggttaatctattgttaaaatttaaagtttcacttgaactttcaaataatgttcttatatttgcagtgtcgaaagaaacaaagtag

SEQ ID NO: 398 - DNA, 17 bp, Artificial sequence
  Synthetic sequence
aaaaaaaaaaaaaaaaa

SEQ ID NO: 399 - DNA, 37 bp, Artificial sequence
  Synthetic sequence
cacttgaactttcaaataatgttcttatatttgcagt

SEQ ID NO: 400 - DNA, 63 bp, Artificial sequence
  Synthetic sequence
  misc_feature (6)..(12): N can be any nucleotide, and the Ns at these positions can be present or absent such that a total number of 3 to 7 Ns can be present.
  misc_feature (18)..(55): N can be any nucleotide, and the Ns at these positions can be present or absent such that a total number of 36 to 38 Ns can be present.
  misc_feature (58)..(59): N can be any nucleotide
gttaannnnnnngttaannnnnnnnnnnnnnnnnnnnnnnnnnnnnnnnnnnnnntanntttg

SEQ ID NO: 401 - DNA, 78 bp, Artificial sequence
  Synthetic sequence
  misc_feature (6)..(12): N can be any nucleotide, and the Ns at these positions can be present or absent such that a total number of 3 to 7 Ns can be present.
  misc_feature (18)..(55): N can be any nucleotide, and the Ns at these positions can be present or absent such that a total number of 36 to 38 Ns can be present.
  misc_feature (58)..(59): N can be any nucleotide
  misc_feature (64)..(75): N can be any nucleotide, and the Ns at these positions can be present or absent such that a total number of 4 to 12 Ns can be present.
gttaannnnnnngttaannnnnnnnnnnnnnnnnnnnnnnnnnnnnnnnnnnnnntanntttgnnnnnnnnnnnngaa

SEQ ID NO: 402 - DNA, 64 bp, Artificial sequence
  Synthetic sequence
  misc_feature (6)..(12): N can be any nucleotide, and the Ns at these positions can be present or absent such that a total number of 3 to 7 Ns can be present.
  misc_feature (18)..(33): N can be any nucleotide, and the Ns at these positions can be present or absent such that a total number of 14 to 16 Ns can be present.
  misc_feature (37)..(56): N can be any nucleotide, and the Ns at these positions can be present or absent such that a total number of 18 to 20 Ns can be present.
  misc_feature (59)..(60): N can be any nucleotide
gttaannnnnnngttaannnnnnnnnnnnnnnnttgnnnnnnnnnnnnnnnnnnnntanntttg

SEQ ID NO: 403 - DNA, 79 bp, Artificial sequence
  Synthetic sequence
  misc_feature (6)..(12): N can be any nucleotide, and the Ns at these positions can be present or absent such that a total number of 3 to 7 Ns can be present.
  misc_feature (18)..(33): N can be any nucleotide, and the Ns at these positions can be present or absent such that a total number of 14 to 16 Ns can be present.
  misc_feature (37)..(56): N can be any nucleotide, and the Ns at these positions can be present or absent such that a total number of 18 to 20 Ns can be present.
  misc_feature (59)..(60): N can be any nucleotide
  misc_feature (65)..(76): N can be any nucleotide, and the Ns at these positions can be present or absent such that a total number of 4 to 12 Ns can be present.
gttaannnnnnngttaannnnnnnnnnnnnnnnttgnnnnnnnnnnnnnnnnnnnntanntttgnnnnnnnnnnnngaa

SEQ ID NO: 404 - DNA, 65 bp, Artificial sequence
  Synthetic sequence
  misc_feature (6)..(12): N can be any nucleotide, and the Ns at these positions can be present or absent such that a total number of 3 to 7 Ns can be present.
  misc_feature (19)..(34): N can be any nucleotide, and the Ns at these positions can be present or absent such that a total number of 14 to 16 Ns can be present.
  misc_feature (38)..(57): N can be any nucleotide, and the Ns at these positions can be present or absent such that a total number of 18 to 20 Ns can be present.
  misc_feature (60)..(61): N can be any nucleotide
gttaannnnnnngttaaannnnnnnnnnnnnnnnttgnnnnnnnnnnnnnnnnnnnntanntttg

SEQ ID NO: 405 - DNA, 55 bp, Artificial sequence
  Synthetic sequence
agttaatgcacgttaaagtatttgctactgagaaatatatccgtatatttgcagt

SEQ ID NO: 406 - DNA, 114 bp, Artificial sequence
  Synthetic sequence
gagtaactacgataataaagtgataattcaatgttaaaacagttaatgcacgttaaagtatttgctactgagaaatatatccgtatatttgcagcgtagaagttattactaacg

SEQ ID NO: 407 - DNA, 91 bp, Artificial sequence
  Synthetic sequence
tgataattcaatgttaaaacagttaatgcacgttaaagtatttgctactgagaaatatatccgtatatttgcagcgtagaagttattacta

SEQ ID NO: 408 - DNA, 17 bp, Artificial sequence
  Synthetic sequence
aaaaaaaaaaaaaaaaa

SEQ ID NO: 409 - DNA, 44 bp, Artificial sequence
  Synthetic sequence
gataaaacgaaaggctcagtcgaaagactgggcctttcgtttta

SEQ ID NO: 410 - protein, 30 aa, Artificial sequence
  Synthetic sequence
HHHHHHGGDYKDHDGDYKDHDIDYKDDDDK

SEQ ID NO: 411 - protein, 7 aa, Artificial sequence
  Synthetic sequence
RYTVELA

SEQ ID NO: 412 - protein, 20 aa, Artificial sequence
  Synthetic sequence
VTLVGNTFLQSTINRTIGVL

SEQ ID NO: 413 - protein, 6 aa, Artificial sequence
  Synthetic sequence
MQPPGC

SEQ ID NO: 414 - protein, 8 aa, Artificial sequence
  Synthetic sequence
TEEEQQLY

SEQ ID NO: 415 - protein, 3 aa, Artificial sequence
  Synthetic sequence
KPV

SEQ ID NO: 416 - protein, 9 aa, Artificial sequence
  Synthetic sequence
YCWSQYLCY

SEQ ID NO: 417 - protein, 14 aa, Artificial sequence
  Synthetic sequence
TSLDASIIWAMMQN

SEQ ID NO: 418 - protein, 4 aa, Artificial sequence
  Synthetic sequence
AAAA

SEQ ID NO: 419 - protein, 4 aa, Artificial sequence
  Synthetic sequence
AAAA

SEQ ID NO: 420 - protein, 8 aa, Artificial sequence
  Synthetic sequence
GSGSSGGS

SEQ ID NO: 421 - protein, 8 aa, Artificial sequence
  Synthetic sequence
SGPTTAPG

SEQ ID NO: 422 - protein, 8 aa, Artificial sequence
  Synthetic sequence
SGPTGHGR

SEQ ID NO: 423 - protein, 8 aa, Artificial sequence
  Synthetic sequence
SGPTGMAR

SEQ ID NO: 424 - protein, 8 aa, Artificial sequence
  Synthetic sequence
SGPTASPL

SEQ ID NO: 425 - protein, 8 aa, Artificial sequence
  Synthetic sequence
SGPTTAPF

SEQ ID NO: 426 - protein, 8 aa, Artificial sequence
  Synthetic sequence
SGPTAAPA

SEQ ID NO: 427 - protein, 4 aa, Artificial sequence
  Synthetic sequence
GHGR

SEQ ID NO: 428 - protein, 4 aa, Artificial sequence
  Synthetic sequence
GMAR

SEQ ID NO: 429 - protein, 4 aa, Artificial sequence
  Synthetic sequence
ASPL

SEQ ID NO: 430 - protein, 3 aa, Artificial sequence
  Synthetic sequence
VPY

SEQ ID NO: 431 - protein, 4 aa, Artificial sequence
  Synthetic sequence
TAPY

SEQ ID NO: 432 - protein, 3 aa, Artificial sequence
  Synthetic sequence
VPF

SEQ ID NO: 433 - protein, 4 aa, Artificial sequence
  Synthetic sequence
TAPF

SEQ ID NO: 434 - protein, 5 aa, Artificial sequence
  Synthetic sequence
STAPF

SEQ ID NO: 435 - protein, 5 aa, Artificial sequence
  Synthetic sequence
GTAPF

SEQ ID NO: 436 - protein, 5 aa, Artificial sequence
  Synthetic sequence
TTAPF

SEQ ID NO: 437 - protein, 5 aa, Artificial sequence
  Synthetic sequence
PTAPF

SEQ ID NO: 438 - protein, 6 aa, Artificial sequence
  Synthetic sequence
SSTAPF

SEQ ID NO: 439 - protein, 6 aa, Artificial sequence
  Synthetic sequence
GSTAPF

SEQ ID NO: 440 - protein, 6 aa, Artificial sequence
  Synthetic sequence
TSTAPF

SEQ ID NO: 441 - protein, 6 aa, Artificial sequence
  Synthetic sequence
PSTAPF

SEQ ID NO: 442 - protein, 6 aa, Artificial sequence
  Synthetic sequence
SGTAPF

SEQ ID NO: 443 - protein, 6 aa, Artificial sequence
  Synthetic sequence
TGTAPF

SEQ ID NO: 444 - protein, 6 aa, Artificial sequence
  Synthetic sequence
GGTAPF

SEQ ID NO: 445 - protein, 6 aa, Artificial sequence
  Synthetic sequence
PGTAPF

SEQ ID NO: 446 - protein, 6 aa, Artificial sequence
  Synthetic sequence
STTAPF

SEQ ID NO: 447 - protein, 6 aa, Artificial sequence
  Synthetic sequence
GTTAPF

SEQ ID NO: 448 - protein, 6 aa, Artificial sequence
  Synthetic sequence
TTTAPF

SEQ ID NO: 449 - protein, 6 aa, Artificial sequence
  Synthetic sequence
PTTAPF

SEQ ID NO: 450 - protein, 6 aa, Artificial sequence
  Synthetic sequence
SPTAPF

SEQ ID NO: 451 - protein, 6 aa, Artificial sequence
  Synthetic sequence
GPTAPF

SEQ ID NO: 452 - protein, 6 aa, Artificial sequence
  Synthetic sequence
TPTAPF

SEQ ID NO: 453 - protein, 6 aa, Artificial sequence
  Synthetic sequence
PPTAPF

SEQ ID NO: 454 - protein, 4 aa, Artificial sequence
  Synthetic sequence
AAAA

SEQ ID NO: 455 - protein, 4 aa, Artificial sequence
  Synthetic sequence
AAAA

SEQ ID NO: 456 - protein, 4 aa, Artificial sequence
  Synthetic sequence
AAAA

SEQ ID NO: 457 - protein, 4 aa, Artificial sequence
  Synthetic sequence
AAAA

SEQ ID NO: 458 - protein, 281 aa, Bacteroides thetaiotaomicron
MKTIKQIVFCVSLLLVMNCFYSCSNSNDVVINTQQNQEKTQDVEIQELIDFIETLNANKIQTRGPFWNRIKRFLVGDAWGYGWGVNKGLTPRGGLITAVVFSLICAASDDDLPRNWWHLSSNWKVYDAPLRPYEIIGNDHNKTIYNMMREDPVIANGTFSNYYLYNSTNKKLKSYGYTEEMPLLLQTRLLEIMDLVKKSTSVDQLMNLMKQEFPQRVSEFQLVESYINGLVNMDDKSTVRDYTKQVYAQIDASSLDVSAVSRLKTMIAIAENSKFLWVETK

SEQ ID NO: 459 - protein, 820 aa, Bacteroides thetaiotaomicron
MMKKTILLTSIIAIAIVSMLSSCVDSEKDLYDPSYQTANPMGDGFAAPDGFDWNMTTTSILNIEIDDELYNQIEILDANPFSTSDYHILAKGVAKKGQAFSQEINYTEGTNYLYIRKTDSRSRVSISTWDVSKNKEFVGSRTTRVAKATIGSYNIPEKYPEETYDTTGAIELTGNTNWNQSNHHLEAGKSYIIKNKFNGEINHTSGYLNGGRFTIFVEGEWTPSQNQIQSADIIILKGGKINTDSFTSFLIADNSILTIQSGGSLIGNNINLAAIGVLLKNFGTISVNSMKDLNTTSILYNAPKATINVTGKSVASWEQSVFTKGAIYNFGELTIQEGALKFNSQDATCYFYNGTEATINTPTFIIGGIGVNDGTVNAQKISNDNGGNPTFTNNCSLYAQNSFEFGGTSGTIIMNKGILAGGVENGTFIAIPSFKCGNSGSTFELNNGSMIKAEIMDIPNVTFKAAGTRSLIKSTKSISTGWTTKFNGNLDIECPEGEFAKGVPANNPNYIMENSVELYIPNGSKTIITSCGELSEIPDPTPDPEDPEFPIEVEDNKDYTYLFEDQWPLYGDYDMNDIVLTIQKRKIYTNKENKVTKFELSIDLSAAGATKSIGAAIMLDNVPANAITQSVEFSDNTLAKNFNLNNNNIESGQDYAVIPLFDDAHKVLGRDRYEQINTVSDYAGNTKPKNISFSITFNNPTISADAFNVNNLNVFIIVDGNRNPRKEIHVAGYQPTKLANTDLFGGNNDNSHHGSKKYYISKENLAWGIMVPSNFKWPLEYVNIKTAYSQFSDWVTSGGTENEKWWNDFDVNKVFQTNKN

SEQ ID NO: 460 - protein, 230 aa, Bacteroides thetaiotaomicron
MFFLAGICAALAACSSDSDDVSSSPSNTPAILEVVSYKFVQEETDVVERVEYPVVVLQHKVNDKDEPLPMIYAWDVEEEENSLFVLTEGSLPVNAENLADLKIPVPFIDAGGKLFIDGTGAKTPLIFGETLKVKNGSRSIGNVKYKIPPYSTYELTKQECGYRCTLTFYLVLKAVNKGEEYHLKGRWTGEQLREQKMGLIDLSDEKGAEKTVLMEAPIELFEKDYETGLD

SEQ ID NO: 461 - protein, 523 aa, Bacteroides thetaiotaomicron
MMKNMILPIAFTALIASMTACSDETDPILTQKNWDGTATYFQSSDEHGFSMYYKPQVGFVGDPMPFYDPVAKDFKVMYLQDYRPNPEATYHPIFGVATKDGATYESLGELISCGGRDEQDAAIGTGGTIYNPADKLYYTFYTGNKFKPSSDQNAQVVMVATSPDFKTWTKNRTFYLKGDTYGYDKNDFRDPFLFQTEDGVYHMLIATRKNGKGHIAEFTSADLKEWESAGTFMTMMWDRFYECPDVFKMGDWWYLIYSEQASFMRKVQYFKGRTLEDLKATTANDAGIWPDNREGMLDSRAFYAGKTASDGTNRYIWGWCPTRAGNDNGNVGDVEPEWAGNLVAQRLIQHEDGTLTLGVPDAIDRKYTSAQEVKVMAKDGNMIESGKTYTLGEGASVIFNRLKVHNKISFTVKTASNTDRFGISFVRGTDSASWYSIHVNADEGKANFEKDGDDAKYLFDNKFNIPADNEYRVTIYSDQSVCVTYINDQLSFTNRIYQMQKNPWSLCCYKGEITVSDVQVSTY

SEQ ID NO: 462 - protein, 570 aa, Bacteroides thetaiotaomicron
MKKIIYIATIGITLLTTSCDDFLDRQVPQGIVTGDQIASPEYVDNLVISAYAIWATGDDINSSFSLWNYDVRSDDCYKGGSGTEDGGVFNALEISKGINTTDWNINDIWKRLYQCITRANTALQSLDQMDEKTYPLKNQRIAEMRFLRGHAHFMLKQLFKKIVIVNDENMEPDAYNELSNTTYTNDEQWQKIADDFQFAYDNLPEVQIEKGRPAQAAAAAYLAKTYLYKAYRQDGADNALTGINEEDLKQVVKYTDPLIMAKGGYGLETDYSMNFLPQYENGAESVWAIQYSINDGTYNGNLNWGMGLTTPQILGCCDFHKPSQNLVNAFKTDSQGKPLFSTYDNENYEVATDNVDPRLFHTVGMPGFPYKYNEGYIIQKNDDWSRSKGLYGYYVSLKENVDPDCDCLKKGSYWASSLNHIVIRYADVLLMRAEALIQLNDGRITDAISLINEVRSRAAGSTMLIFNYKEDYGVNFKVTPYDLKAYAQDEAMKMLKWERRVEFGMESSRFFDLVRWGEAKDVINAYYVTEASRCSIYKNAGFTENKNEYLPVPFEQISASNGNYTQNFGW

SEQ ID NO: 463 - protein, 1038 aa, Bacteroides thetaiotaomicron
MKRKFVKVMFFGALALSTVTYVGCKDYDDDIKNVQEQIDAINKKGADVTTEAMTAAINSAVAGLQTQLDAIASKADKTALDELKKTVTDLQAALNNKADAIKLTELQTKLDEAIAKVNASIESSVGAAKTELQAKIDKLQADLEKADADAAEKIATELAAVKTELQGLINANGEKIADLYEKIKGLDAIKTKIEALEEADKNFVTISQLNDYMNSEAVKAYVDEALVDYLTSAEVTEQVNAVKTYVDGTFKAAIMAEIKAEYLSLEKYNADMEALMEKIDTYVGKEDAAYKKIFTDITALQTYQQQTIEVLVASLAENNTIENANKIVGALEDITTLQTEIAKCAKTTDLDAYVKGTELGGLIDTHLQDKFAGYDGEIADIKKRLLALEIDVDGLKSMVQSVTFVPSDSEGKVYFSSYYVVSEGETEKTLIASNNTVTVKFRVSPVSAAKNFFDNYTASFDAQEITTRAANIFEGEGKVENADEGIISFVISTTTEQSHAVCLNIIAKNSVPENAETAIKGTDYFTNINSNYFPVIVTTKTISGIQVESTNSTVSSIYYNKEASKIDYKAGVALKARFVDGGNATLDPENVDLSNLVTSYEFDKDMTNPDAPVILDGDGSYKLEDGVLSLKNYAAESAGKEATVVAYVAVKDGDNTLKEFKSTAYAKVTAANYTDGTVNLTPVAPTDVLYDGTKVTSTSAYALTELYTSAGSKDIYEAIPVDKFTPTADKGVTFVIGEKNALTINVPKGTAAGTYSPTLKIQVDAVKVINVSASVKVSYQDIKVVIDGNIVSAGAMTLKPTYQGSYEKPTSVGFTLDLATLYTNYATQLAAVKKVGGDITLTLKDAVKGASINGTTLTVDKTYNAHADDINPIVIVAKTVYGEATLDNSTVETKINLTEISGTWAFTIKSAAFGKDNLNSTLNIAKTASWTDYRGKVMWADGAEKAQGTTEWGAKPLSVYGFTAPVFSIATADADKAKYVNITTDGKISLTDAGKNLASAITLKVNVAAVSNWGTITDFASNNEVTVKIDLSQDAADI

SEQ ID NO: 464 - protein, 413 aa, Bacteroides thetaiotaomicron
MMTGLTLLSCSTENDEFKKELPPTEQPSEPTGALLERFSIDQLPAKTIYALGESIDLTGLKVTGEYDDGKQRSVNVAPKQISGFSSSVPVDKQEVTITIEGKQKSFTIQVAPVRVENGVLTEVLKGYDEIILPNSVKSIPKNAFNGSKINKVTLNEGLKSIGDMAFFNSTIQEVIFPSTLEQLEENIFYYCYHLKKADLSRTKLTKLPASTFVYAGVEEVLLPATLTEIDAQAFLKTSQLKTIEIPENVRTIGLEAFRESSITTVKLPNGVTNIAQRAFYYCPELTEVTTYGTVFNDDPEAMIHPYCLEGCPQLTRFEIPQSIRILGQGLLGGNRKVTQLTIPANVTQINFSAFNNTGIKEVKVEGITPPQVFEKIWYGFPDDITVIRVPAESVEKYKTAAGWQDYTNKIQAS

SEQ ID NO: 465 - protein, 399 aa, Bacteroides thetaiotaomicron
MSGTAEVNPITVDVYLDITVENISTLKDLTVKFDNYDEDLHYVKEVTDNSVKVDGIIPGIYSVTVSGTAIDTENNEYYINGNSVNAALFKHGSALNIEVQGLKVSPLIFKEIYYCGSRPEKGGVYFRDQFYEIYNNSADILYLDGIYFANLTPGTATTKLPIWPEADGNNYAYGERVWKFPGNGTEYPLAPGESCIISQFAANHQLDIYNPQSPIDGSSSEFEFNMNNPNFPDQAAYDMQHVFYQGKAEMGSIPQYLTSVFGGAYVIFRVPEGEAWDPVNDENMKTTDLSKPNSNVYYAKIPIKYVLDAVEAVNNESKMNAKRVPGVLDAGITWVGATYCGLGIARKLSTDEEGNPIIREETGTYIYQDTNNSTDDFERGVVPVMRRNGAKMPSWNHTL

SEQ ID NO: 466 - protein, 144 aa, Bacteroides thetaiotaomicron
MKKFNDANVGLFVLLTACLSLFSCNNDNDNYPKDYVGFEKSTRTVECDKNQSESELQIKIIATDKSKEDRTVLLATPALPAGQAPIMKLTETKVTIKAGQKSATTTIKLYPKKMVLKQQNITLSCTPQWKEGSVSKLTILLKRN

SEQ ID NO: 467 - protein, 565 aa, Bacteroides thetaiotaomicron
MKKIQYVKLVGLLTILLFLNISCKDDDTLLRGSGITEQSWSTNQTYFASAEQTLTFTFTTLSSWTAQNSSTALLSLDNTAGNSGENTIKVTVHKSSQEQGTITIKVNGYSSASNIKIQLSDDDVQGYEINYSVDQYLREKYLWNDDYKLLTPNFRQAYDEFLRNTLLSMTTNTLDKKRNSNGTYSLFSFIQKLDPDLQTSRSAKEKKTLEYNYGFVNFIAVGNRNNSNYGLVIQGVHKGSSADKEGLKRGMEITEIDNQRITTTNVQACYSKLIKPSSPTSIKVKDKDGKVYTINSGPIYANPIIHHQVNEKIGYLVYSAFESGFDQELFDVFKEFKSQNITELILDLRYNGGGDVTSANLISSCIAGDLCIDKTFASYRYNDERMKVLGNQRPIQKFAYSQYDNLSTSLSAGGLNLRKIYCLVTDDSASASELVINALRGIDIEVILIGTTTHGKNVGMEGVELTAGTDKYLLFPITFQAYNAKGFGDFENGFTPDYEINENKPNGEYFEGYGDFGAESDPLYAKAISLISGNEVTTPTRAVNQAKEQMLVIATPRLNRIGMIK

SEQ ID NO: 468 - protein, 498 aa, Bacteroides thetaiotaomicron
MKKILLYASLATTALFAGCDLNINDDPNYPMNDQVTADLIFPSISASIASAVGGEIYNYAGFFAQYYEQKPESNQYNTLCEYTFTESSQQMDYSYRILFAGALEDAKQVLEKTTNPADRFATTILRAYAFQIMVDNTSDSPYSEALQGNANATPKWDTGETVYKGILGEIDAAEAALDGSGMDVPDLIFNKNIAQWKGFANALRLRMYLRFIDANIDAASYTEKVKTLVQNNEFFTGDVKLDCFLDETDKRNPWYNTNAVGLTGNHCAAYPLVSYLSSTGDPRIAYGISKTDADGKYVGQLPGGKTHMQSILGTDNWKNKNVSAIDYSIGATKPVYFFTQAELQFLIAEVYARFHNDDANAKSAYEAGVTADFAVRGFAGQENTILEGACAWSAASTQADKLNLIYMQKWVSLFYMDHMEAWSEIRRTDCPKLSSYSAAQIQASESVYTPGELVAPWTNGLEAGGLMKRMTYPLSARQQNVNTPAGVPGSTPVWWDIK

SEQ ID NO: 469 - protein, 386 aa, Bacteroides thetaiotaomicron
MFYCMKKNLLFAAMAVTALASCSNDDVVDVNNGGGISFRASLDRAVTRTNVTSLQNLAAFNVTAIGDGKNYFTDLGVSSADNGVNWTTASTYYWPGYELAFFAYAPQAPAGTVSIDNASKKITGFSPAQAVADQKDLVISYNTGTKAVNEGPGVAMNFKHALSQIEVKAKCSNDKIKIEIMGVKLVNAAAKAEFAFPETETKSSYVLQQSQWSNWSEKDDPTKAYMIKGGAPVILTADAQRIMFGDDNFMLIPQQLTAWDGTTATTGAYLSVLCRIYSLDGANEILLYPQPAAGDAKDGKYAFSAVGINTNWEPGKKYTYTLNFCGNGGGTGEIDPNPTDPTNPTDPTIDPDPVPGGNGGDPVLGNPIKFTVTVDEWTDQPVDVAM

SEQ ID NO: 470 - protein, 426 aa, Bacteroides thetaiotaomicron
MKQHAHLLILTIMFLTSCSDDTEVMKQESSPPSLTEKAPTYRTKENAIIEVELFIKNNRNNTRNSSFLNYSINNEIYFYRDTITNQTYPSFYIANAEGGNGYAIVSANLYTTPIIAYSESGNLSLSDTLQYQELSFFFDLVQNYISNNKKYEIEFKEENDDDNSLDTSQTRGRRRPIYIKKPGEWEETERVQPLISVKWGQRSPYNNAAPLIEGQRALTGCVATAIAQVMAYHEKPSGYNGVSYNWSEMKQFPTTPAVAHLFRSIGDLVKMDWGTDTSGAKRKNIPQCFEKMGYRKPNNPQIYSQWDVITSIKAKCPVIICGNSVRKKILGIKYYQNGHAWVSDGYFHRERNVDVYRKGSDKVHHSYTEKEDYLHLNWGWNGNSNGYYLAGIFNGGEGPTFPSTRAAGKGNYPYNVEIIPYINIIK

SEQ ID NO: 471 - protein, 702 aa, Bacteroides thetaiotaomicron
MIFHRIFRFTYFLIFCIWGLQSCTKDDLIETPADTDSETTENPYGIIRIAEKDLTPDVFKLMLQDDEPATILFNNTQRGFRVNQPLQVSITEQQELFIRFYSPRPVKEVTVWATISGYEEAFQLAKFDVLPAFTEFHKELPMLTQSKRYITRSGKEIQIMANPHLSAADFKLEIECNDKYYQKLLSTKSKYNVRFSAYSQTGSWAYPLYPAHAREAVAMMLNYGYMFSSKEFAEELEKYRGKLHSDANKTVIDIDMLLKKVINHSGFVIGKVTTVDGLGGGETYGLNEWCFLEHYADDGAHTSATFHELGHCLGYGHSGNMTYEQTGTGWITLCATVYNKLCIEKKLPVYSRRFMHTRRYGKLYGSSKYNASRYIIEDPELDAIDGGLSPILKEEDEDTAQGTPLSCIITYKDIPQATESTFAPKDVCVYGNRIYIVNNASGNFSLEILEEQNGKLTHIKSLKEWTEGGATKGFAATPNGVTVAHGKIYVTNEQSRTDIFDEKTFELVATIGTGSWGEGSNQTVHAFDVLVHRGCVFIRDKKRVCVFIEDDIVPGKSFKNVPNYCRTSNMGEAMGTYGQTIGNDGLLYTTHQGNKKIYVFDLQAMREQVEWKAQRVINLTSYSPYDIAFIGKRMFVSFATGKNQPIALAEVNPETGTVIKDYTTVEGHTFSNVEKMSMARQTLFIVDRNAHTVTGIPVEKLN

SEQ ID NO: 472 - protein, 534 aa, Bacteroides thetaiotaomicron
MFLLIITSCYEDKGNYDYREMNDIEISVETESSSYALGDKVTSKPKLVFTLGKESSDLSYEWTFDGHVIADTRDLEWVADTIASTKELRLAVMDNNTGVTYFGSTYISVSSAYASNGWVVLSEKEGISTLAFLREQTEEGILKPVVTRDIYQMINGVPMGTQPVSMYPHWTERWDGEDKTSWLWVAQKGGQGAVDISGSSYKQEGILSQMFLSKSYPEGFVPVGVIDMQFLTMAIGEDGTIYTRVKDSNLLFNSSNFLDRPLTSDEEGKVKVDGSMIAYAPFDEHGGMVLYDKNSSQYLHIADYKSWQGYNYSGKVLPLKVEEYEYGPSDARLDNMKDYSVYFVGASLVDWGDVSYMSIIKDKAGRFYIQKFTVEAYGGGSSVTKVGASFTSQSEIEGLSSVIDGTSKNCFYLCRNQDKAPYLFISKGETLYFYYTDGNKIYTCAQFDSPITSIDAECFNNKYIIVGLENGDVYILKGDDDNSDYTLKKYVIQQNKVIQVNDAENKFVLFHEKDFGRIIQVRYKWKESWNESFS

SEQ ID NO: 473 - protein, 429 aa, Bacteroides thetaiotaomicron
MMKQYIFSALCLVSGAFCLSSCNDDKEARPYTPDYEIVPEYTNADTWKAYEAFNEHLLDQNKFIYKSSTADKAAVDRWNGAAAIWCQPTYWDMAMNAYKRAKAEGDTQKEQKFKQLCDDLFAGNKAHYANFDFDDNNENTGWFIYDDIMWWTVTLARAYELFGVEEYLSLSEESFGRVWYGSEKVGDTGSYADPEKGLGGGMFWQWQPIKNPNPNEADHGKMACINFPTVVAALTLYNNVPTGRTESTDSHPSYQTKEQYLAKGKEIYAWAVENLVDVTTGQVADSRHGNGNPAWKDHVYNQASYIGASVLLYKATGEKQYLDNAVMAADYTMNTISGTFDLLPFETGAEQGIYTAVFAQYIAMLVYDCDQTQYIPFVKRNINYGWANRDKTRDICGGDYTKLQVEGDAVESYSASGIPALMLLFPTDK

SEQ ID NO: 474 - protein, 235 aa, Bacteroides thetaiotaomicron
MITKKKKYTLYYVMALACGLVASFFIYSCSADGYYSEEIEKNEVTNTRALSSKMINNGSTLIDSIASSDEFWEFEMSSELLADKFHEYTSILSEEEYDKLMENLNDDDYVEDFMRKANLENELQQLAKAKENLIKHTRFLRLSADERTQLFILYAESNELTKVKLLKTREEGGSTSSCEEQKQAAYKQAKADYDNAIANCQNGSMPSGCLIQAAAKYDRAKDIANKEYKECIANK

SEQ ID NO: 475 - protein, 536 aa, Bacteroides thetaiotaomicron
MKQIIFIAILLTCAFGACSSDNDGDEQSASVQAPSDITIERMGKTKVLLRWKDNSNNETGFSILLRKADTSENIEIAKVSANVTEYTIENGLEEGNIYYFGVRAFSATNTSRAIYELYRLVALGDEPSIAIIGSIKANSTCISSSYQVTNIAGQTNVKYGLCWSTENTPTINDQKQNGPEVAEDGKVFQVIPNTLLDYGKSYKVRAFLTTSTGTYYSAESTVSLETEPQAIQLTWNKLTKSTLPAEIELYETTSNLNGSNFHAWYAIGDLSTGKVEVRVHIPSSPATIDTQSASFNGDCYLLVNGGYFYNGNHTGIAVINSIKSGSVSAVRGSLKTGDTEYNSMYNVTRGTFGVDASGKPNVVWTGTDASSNVFYFDRPLPSVKGENKYGIVTNENPTTAISWSPKYALSAGPVLLKDKKIPFDFTETSKGTDYYLSNYEIIPYDIFGANVTPDRTAIGYREDGKVVIFICDGRITASGGATLTELAQIMKGLGCVGAINLDGGGSTGMVVGDEHLNDMTGGNRAVVSTIGFFKKN

SEQ ID NO: 476 - protein, 629 aa, Bacteroides thetaiotaomicron
MNYSCRKTIVPIIIGTLLSGACSNDEPTGGKGHQQTYSVVLKGITVAGEESSEELKDVSVFQFSDGNLYKEEQLTPGQGGQSEISAVSGSRLYFLTGLEIPAGEKAKSEEEFRNTIIGEGLHDNSAPDFMAAVVELESGVVTRSNAEVNVIMKRGVARIDLNTTADSKTQIKEVIVENAPAETLPFLENVRASDKTVSYRKEFSSAFDGKQEGVFRLFESTRPVNIILRGTYGEVPIRLKVELPVVERNKVYELAVLNVGAEVTGVFEIKPWEEGETIVGKPDTNQRLLLNASKSRIPEGVKVDYENNILEVPATGADDMTLAFVTDTRIDISSTEGAGSGTSVGNMSVSEEAEGIVSSFNVSVAAQGSGRLGYTVLVHLKNALLSGTYDYVEIRVAPSDKQIETVEIAGNVWMAFNARSRDLEDQIYPLDGATVEDMYHKSWINTVGGLFQFGRLYMYVPWQGYNPSNNLGNQTADAPWVNDTHMPCPEGYRIPTGNEWQSLLPADQEIPGRYKAGNGETIAATLHIGEGTLITPSSGVTGTQHYVKFTSEDTGRSLIIPLAGSKGDKSSSNNPAFGKRAVLWTNERNGLPGGYAWAYWLPFEGAETTVIKKQRLQMEAFASVRCVKK

SEQ ID NO: 477 - protein, 374 aa, Bacteroides thetaiotaomicron
MKIKTLIACFILACAATSCIQDEALNSEAAIDACTGDDVQLANINADSKLINVYVNKGADLSKQKLEFVIPEGATIKINDQVAGDTEATYDFSEETHSRKFTVTSEDGQWKPVYTVKVVLAELPTSFNFEELLPSNDYDIFYEFQPGTSQEISKVLQWSSGNPGFKLTGMANSKTDYPTVQVANGFRGKGVKLETRDTGSFGAMVKMYIAAGNLFIGTFEVGNALTDPRKATNFGFQFYKRPKTLKGHYKFKAGDVYSVEGKPQEGVRDKCDIYAVMYEAENNSVMLNGDDVFTSDKLVSLARIKPEDVVESDQWTDFEIPFEPVKGRVIDDTKLKNGKYKLGIVLSSSVDGAYFKGAVGSTLYVDEVELICED

SEQ ID NO: 478 - protein, 143 aa, Bacteroides thetaiotaomicron
MKRIVFWMVALLLMSGVAMAQGNRQGGRQQMDPKTRAERMTERMVKEYSLNEDQKQQLQDVNLTWVQKMAANQGGRSKDNKAAKMTKEEREKKMAEMKKSREDYDAQLKKIMTKEQYDSYVKKQAEREKQMKEGRQNRQKRQG

SEQ ID NO: 479 - protein, 545 aa, Bacteroides thetaiotaomicron
MKIVKYIVIVSLFSISACSDDDDKKNNERPGNLVELQVDVNEINIAQGDTRTVNITSGNGEYVATSANEEVVVAEIDGNVVKLTAVEGHNNAQGVVYVSDKYFQRTKILVNTAAEFELKLNKTLFTLYSQVEGSDEALIKIYTGNGGYSLEVIDDKNCIEVDQSTLEDTESFMVKGIAQGNAEIKITDQKGKEAFVNLNVIAPKQITTDADEKGVLINSNQGSQQVKILTGNGEYKVLDAGDAKIIRLEVYGNVVTVTGRKAGETSFTLTDAKGQVSQTIHVKIAPEKRWYMNLGKEYAVWTHFAEMTGEGLEAVKVETNGFKLKKMTWELVARIDGTNWLQTFMGKEGYFILRGGDWENNKGRQMELVGIDDKLKLRTGHGAFELGKWSHIALVVDCSKGKDDYNEKYKLYVNGKQVKWDDSRKTDMDYSEIDLCAGNDGGRVSIGRASDNRCFLDGAILEARIWTVCRTEEQLKANAWELHEQNPEGLLGRWDFSAGAPTSYIEDGTNSDHELLMHISKYDSWNATEFPMSRFGEAPIEVPFK

SEQ ID NO: 480 - protein, 258 aa, Bacteroides thetaiotaomicron
MKKFNWLLVMLLLALVPALQSCDDDGYSIGDIGWDWATVRATGGGGYYLEGDRWGMIDPVASSIPWYKPVDGERVVAFFNPLADTDKGAQVKIEGIQEVLTKEVEDMTAENEEEFGNDPIVIYQGDMWLGGKFLNIIFHQYLPRSEKHRISLVQNKIEPEAPETPEALNVDEDGYIHLELRYNTYDDVTGYRGWGRVSYNLEEFYPTAKDAAETEFKGFKVTINSKENGEGRVIVLDLDHPVGVPEKAKDVHSTSFVK

SEQ ID NO: 481 - protein, 580 aa, Bacteroides thetaiotaomicron
MKKIRYIIASALVSIGLCACTDTWDSHYSKWETVIDNTEIQAVDEPAADFLKTAQDYSKMYELFDKTGVIKTWQEKNLMYTIMVVGNESTANANQPVTKAEGSEGQATAEEIFKAEAHITDALLSPSNLEDGQRLLMWNGKYVTVRIYDEPVDGMEPGIYFNGSKVKKVIKTNNAYIYDLEDYINTPKALMEYLKDLPDEEYSIFKEMVLSRTQRVFDKAASTPIGIDKTGNTVYDSVFTEKSQYFADKKLDLYSENITATLLVPSNDLIENALKEAKEKLKSWNMEREDSILNNWIFQTAFFSKKYVKQDFIYNESDPASTQDFYSVFDQQWRTTVNKVDLDNPVELSNGVAYKITSLKIPTNKILIWRIKERFETFDQLTDEDKKYYYPGYNYISTYLKDIGENVQMNRVKQYVGANQPKPWLPAVYCKSMMLWVVDTDRPGIFKFKCYRLVEDKASTTGFTAVPYKIPAGPYNFYMGFNGSRSQVNATFYLNGKKIPKCESGPIPSSTMKGSNHDRSGGGYSELYKDSRYDRDGSTDLGVVIFDKTEELEVTIEFTKGAKSDMEPTTWCFRPTVDLY

SEQ ID NO: 482 - protein, 614 aa, Bacteroides thetaiotaomicron
MSMKKNILIIGLASIFGIASGLISCSPDYETEFKVETLVVPDKSQAPITFPLLGGEHEIEVQTNVPLDRWSAQSNAEWCKVVQHEGKVVVSASANNIYKQRRAEITVAYGHQSYSITVSQFGKEPAILIGDKLQQEGYVEIIDAERETLTIPVATNLNLDNIIIPDTCNWIRLAEQPATFDAKTRAAEDVNKQELKFTLDKSTETDVRYCTIILQSSQNYSYTASFLIKQQPRGYIVEIDEDKKIYEVKAMGETITIPFKVNSPAGEVSYTYEVEESAQSWITPVSLPASRALRDVSESFIIKANTEVENQPREGKITFKSTNSTDKVPSQFVVTVKQAGFIATPPLNVINATATPGAGSIQLQWEIPEDVDFNKIKITYYDKVTKENKEILINDYKTTSYIIDDTYQCAGEYSFTINTYGPTGMETDSPVTITGISGEASEMERVTLTIDMLSDNANHVGDGGGLPALIDGKVNTYYHTKWNAPVTTEAHYVQIKLNKPLKDLCFEYDARQSGVNNGGDVKAATIYGSMNGEFFESMGNEEFNLPTTNGGHATAKNNVSGKQAYNYIRFTPTARRDKDPLDYTVAGSAWWNMSEIYLYRIRHDEAWAREQLGI

SEQ ID NO: 483 - protein, 683 aa, Bacteroides thetaiotaomicron
MKKLFKIILGATVGSTLLLSSCNFLDVDPYFEATFKEDSIFHSKKNAEGYLWNTPKGFPDAGAIWGNSWNPGESASDEITLKYQTNEFWGLQFSVGTINSRNLPIQNQWYDMYVIVARCNKMLKEVYNVPDMNEMDRRRYIGYVHFMRGYAYYHLLMNWGPLIIVGDEELSTSEPAEYYNRERATYDESVDYICDEFRLATQGIYSADEQSVNYYQRPTKGAAMALIARLRLFQASPLFNGGAAARKCFGTWKRKSDGAYYVNQEYDPRRWAVAAAAAKQLTKMGYELHTVEADAQNPYPLASNVPTANFPDGAGNIDPYHSYSDMFTGEGIIQTNKEFIWAMESSNVTNYTHHSFPVKFGGWGSMSVPQRVIDCYLMADGRTIHNSSAEYPYEPDFSRLTGESKKLGTYLLRENVPMMYANRSARFYASIGFPGRYWPMSSASTDASYVNQQFWYSHDDTNAGIAGAGNNVNDYSVSGYVPVKYIHPDDSWANGKGSVKGAFVTSPKPFPIIRYGEVLLEYVEALNRVEGTVTVEVSDNTGTLIEETVSRDPAEMAKYFNMIRYRVGLPGVDANDMAEADNFEKIIRNERQVELFNEGYRYFDTRRWGTYLDEDANSSNWRGLDVTKDRTNANGNEGFWNIVTINTQNVRDRIALPKMVFLPIRHDELLKVPNADQNFGWDR

SEQ ID NO: 484 - protein, 273 aa, Bacteroides thetaiotaomicron
MAIAATLLASCNKDEEETEIQGFKVLEYRPAPGQFINEGFDCQTMEEANAYAEERFNKKLYVSLGSFGGYITVKMPKEIKNRKGYDFGIIGNPFSGSSEPGIVWVSEDANGNGKADDVWYELKGSDEPERDYSVTYHRPDAAGDIPWEDNKGESGIIKYLPQYHDQMYYPNWIKEDSYTLKGSMLEARTEQEGGIWKNKDFGKGYADNWGSDMAKDDNGNYRYNQFDLDDAVDQNGNPVTLERIHFVKVQSAILKNVESIGEVSTEVVGFKAF

SEQ ID NO: 485 - protein, 6 aa, Artificial sequence
  Synthetic sequence
AAAAAA

SEQ ID NO: 486 - protein, 6 aa, Artificial sequence
  Synthetic sequence
AAAAAA

SEQ ID NO: 487 - protein, 6 aa, Artificial sequence
  Synthetic sequence
AAAAAA

SEQ ID NO: 488 - protein, 6 aa, Artificial sequence
  Synthetic sequence
AAAAAA

SEQ ID NO: 489 - protein, 6 aa, Artificial sequence
  Synthetic sequence
AAAAAA

SEQ ID NO: 490 - DNA, 82 bp, Artificial sequence
  Synthetic sequence
aatggttaatctattgttaaaatttaaagtttcacttgaactttcaaataatgttcttatatttgcagtgtcgaaagaaaca

SEQ ID NO: 491 - DNA, 76 bp, Artificial sequence
  Synthetic sequence
caatgttaaaacagttaatgcacgttaaagtatttgctactgagaaatatatccgtatatttgcagcgtagaagtt

SEQ ID NO: 492 - DNA, 66 bp, Artificial sequence
  Synthetic sequence
  misc_feature (6)..(12): N can be any nucleotide, and the Ns at these positions can be present or absent such that a total number of 4 to 7 Ns can be present.
  misc_feature (18)..(33): N can be any nucleotide, and the Ns at these positions can be present or absent such that a total number of 12 to 16 Ns can be present.
  misc_feature (37)..(58): N can be any nucleotide, and the Ns at these positions can be present or absent such that a total number of 18 to 22 Ns can be present.
  misc_feature (61)..(62): N can be any nucleotide
gttaannnnnnngttaannnnnnnnnnnnnnnnttgnnnnnnnnnnnnnnnnnnnnnntanntttg

SEQ ID NO: 493 - DNA, 67 bp, Artificial sequence
  Synthetic sequence
  misc_feature (6)..(13): N can be any nucleotide, and the Ns at these positions can be present or absent such that a total number of 4 to 8 Ns can be present.
  misc_feature (19)..(34): N can be any nucleotide, and the Ns at these positions can be present or absent such that a total number of 12 to 16 Ns can be present.
  misc_feature (38)..(59): N can be any nucleotide, and the Ns at these positions can be present or absent such that a total number of 18 to 22 Ns can be present.
  misc_feature (62)..(63): N can be any nucleotide
gttaannnnnnnngttaannnnnnnnnnnnnnnnttgnnnnnnnnnnnnnnnnnnnnnntanntttg

SEQ ID NO: 494 - DNA, 66 bp, Artificial sequence; identical to SEQ ID NO: 492
  Synthetic sequence
  misc_feature (6)..(12): N can be any nucleotide, and the Ns at these positions can be present or absent such that a total number of 3 to 7 Ns can be present.
  misc_feature (18)..(33): N can be any nucleotide, and the Ns at these positions can be present or absent such that a total number of 12 to 16 Ns can be present.
  misc_feature (37)..(58): N can be any nucleotide, and the Ns at these positions can be present or absent such that a total number of 18 to 22 Ns can be present.
  misc_feature (61)..(62): N can be any nucleotide

SEQ ID NO: 495 - DNA, 67 bp, Artificial sequence
  Synthetic sequence
  misc_feature (6)..(12): N can be any nucleotide, and the Ns at these positions can be present or absent such that a total number of 4 to 7 Ns can be present.
  misc_feature (18)..(33): N can be any nucleotide, and the Ns at these positions can be present or absent such that a total number of 12 to 16 Ns can be present.
  misc_feature (37)..(58): N can be any nucleotide, and the Ns at these positions can be present or absent such that a total number of 18 to 22 Ns can be present.
  misc_feature (61)..(62): N can be any nucleotide
gttaannnnnnngttaannnnnnnnnnnnnnnnttgnnnnnnnnnnnnnnnnnnnnnntanntttgc

SEQ ID NO: 496 - DNA, 63 bp, Artificial sequence; identical to SEQ ID NO: 400
  Synthetic sequence
  misc_feature (6)..(12): N can be any nucleotide, and the Ns at these positions can be present or absent such that a total number of 3 to 7 Ns can be present.
  misc_feature (18)..(55): N can be any nucleotide, and the Ns at these positions can be present or absent such that a total number of 36 to 38 Ns can be present.
  misc_feature (58)..(59): N can be any nucleotide

SEQ ID NO: 497 - DNA, 63 bp, Artificial sequence; identical to SEQ ID NO: 400
  Synthetic sequence
  misc_feature (6)..(12): N can be any nucleotide, and the Ns at these positions can be present or absent such that a total number of 4 to 7 Ns can be present.
  misc_feature (18)..(55): N can be any nucleotide, and the Ns at these positions can be present or absent such that a total number of 36 to 38 Ns can be present.
  misc_feature (58)..(59): N can be any nucleotide

SEQ ID NO: 498 - DNA, 63 bp, Artificial sequence; identical to SEQ ID NO: 400
  Synthetic sequence
  misc_feature (6)..(12): N can be any nucleotide, and the Ns at these positions can be present or absent such that a total number of 4 to 7 Ns can be present.
  misc_feature (18)..(55): N can be any nucleotide, and the Ns at these positions can be present or absent such that a total number of 34 to 38 Ns can be present.
  misc_feature (58)..(59): N can be any nucleotide

SEQ ID NO: 499 - DNA, 64 bp, Artificial sequence
  Synthetic sequence
  misc_feature (6)..(12): N can be any nucleotide, and the Ns at these positions can be present or absent such that a total number of 4 to 7 Ns can be present.
  misc_feature (18)..(56): N can be any nucleotide, and the Ns at these positions can be present or absent such that a total number of 36 to 39 Ns can be present.
  misc_feature (59)..(60): N can be any nucleotide
gttaannnnnnngttaannnnnnnnnnnnnnnnnnnnnnnnnnnnnnnnnnnnnnntanntttg

SEQ ID NO: 500 - DNA, 65 bp, Artificial sequence
  Synthetic sequence
  misc_feature (6)..(12): N can be any nucleotide, and the Ns at these positions can be present or absent such that a total number of 4 to 7 Ns can be present.
  misc_feature (18)..(56): N can be any nucleotide, and the Ns at these positions can be present or absent such that a total number of 36 to 39 Ns can be present.
  misc_feature (59)..(60): N can be any nucleotide
gttaannnnnnngttaannnnnnnnnnnnnnnnnnnnnnnnnnnnnnnnnnnnnnntanntttgc

SEQ ID NO: 501 - DNA, 106 bp, Artificial sequence
  Synthetic sequence
  misc_feature (6)..(25): N can be any nucleotide, and the Ns at these positions can be present or absent such that a total number of 0 to 20 Ns can be present.
  misc_feature (31)..(90): N can be any nucleotide, and the Ns at these positions can be present or absent such that a total number of 10 to 60 Ns can be present.
  misc_feature (93)..(102): N can be any nucleotide, and the Ns at these positions can be present or absent such that a total number of 0 to 10 Ns can be present.
gttaannnnnnnnnnnnnnnnnnnngttaannnnnnnnnnnnnnnnnnnnnnnnnnnnnnnnnnnnnnnnnnnnnnnnnnnnnnnnnnnntannnnnnnnnntttg

SEQ ID NO: 502 - DNA, 76 bp, Artificial sequence
  Synthetic sequence
  misc_feature (5)..(14): N can be any nucleotide, and the Ns at these positions can be present or absent such that a total number of 0 to 10 Ns can be present.
  misc_feature (19)..(68): N can be any nucleotide, and the Ns at these positions can be present or absent such that a total number of 30 to 50 Ns can be present.
  misc_feature (71)..(72): N can be any nucleotide
ttaannnnnnnnnnttaannnnnnnnnnnnnnnnnnnnnnnnnnnnnnnnnnnnnnnnnnnnnnnnnntanntttg

SEQ ID NO: 503 - DNA, 17 bp, Artificial sequence
  Synthetic sequence
  misc_feature (6)..(12): N can be any nucleotide, and the Ns at these positions can be present or absent such that a total number of 4 to 7 Ns can be present.
gttaannnnnnngttaa

SEQ ID NO: 504 - DNA, 63 bp, Artificial sequence
  Synthetic sequence
  misc_feature (6)..(59): N can be any nucleotide, and the Ns at these positions can be present or absent such that a total number of 48 to 54 Ns can be present.
gttaannnnnnnnnnnnnnnnnnnnnnnnnnnnnnnnnnnnnnnnnnnnnnnnnnnnnntttg

SEQ ID NO: 505 - DNA, 45 bp, Artificial sequence
  Synthetic sequence
  misc_feature (6)..(43): N can be any nucleotide, and the Ns at these positions can be present or absent such that a total number of 36 to 38 Ns can be present
gttaannnnnnnnnnnnnnnnnnnnnnnnnnnnnnnnnnnnnnta

SEQ ID NO: 506 - DNA, 51 bp, Artificial sequence
  Synthetic sequence
  misc_feature (6)..(47): N can be any nucleotide, and the Ns at these positions can be present or absent such that a total number of 40 to 42 Ns can be present
gttaannnnnnnnnnnnnnnnnnnnnnnnnnnnnnnnnnnnnnnnnntttg

SEQ ID NO: 507 - DNA, 57 bp, Artificial sequence
  Synthetic sequence
  misc_feature (6)..(12): N can be any nucleotide, and the Ns at these positions can be present or absent such that a total number of 3 to 7 Ns can be present
  misc_feature (18)..(55): N can be any nucleotide, and the Ns at these positions can be present or absent such that a total number of 36 to 38 Ns can be present
gttaannnnnnngttaannnnnnnnnnnnnnnnnnnnnnnnnnnnnnnnnnnnnnta

SEQ ID NO: 508 - DNA, 63 bp, Artificial sequence
  Synthetic sequence
  misc_feature (6)..(12): N can be any nucleotide, and the Ns at these positions can be present or absent such that a total number of 3 to 7 Ns can be present
  misc_feature (18)..(59): N can be any nucleotide, and the Ns at these positions can be present or absent such that a total number of 40 to 42 Ns can be present
gttaannnnnnngttaannnnnnnnnnnnnnnnnnnnnnnnnnnnnnnnnnnnnnnnnntttg

SEQ ID NO: 509 - DNA, 63 bp, Artificial sequence
  Synthetic sequence
  misc_feature (6)..(55): N can be any nucleotide, and the Ns at these positions can be present or absent such that a total number of 44 to 50 Ns can be present
  misc_feature (58)..(59): n is any nucleotide
gttaannnnnnnnnnnnnnnnnnnnnnnnnnnnnnnnnnnnnnnnnnnnnnnnnntanntttg

SEQ ID NO: 510 - DNA, 51 bp, Artificial sequence
  Synthetic sequence
  misc_feature (6)..(43): N can be any nucleotide, and the Ns at these positions can be present or absent such that a total number of 36 to 38 Ns can be present
  misc_feature (46)..(47): n is any nucleotide
gttaannnnnnnnnnnnnnnnnnnnnnnnnnnnnnnnnnnnnntanntttg

SEQ ID NO: 511 - DNA, 515 bp, Artificial sequence
  Synthetic sequence
ggctacttttgcacccgctttccaagagaagaaagccttgataaattgacttagtgtaaaagcaagtgtctgcttaaccataagaacaaaaaaacttccgataaagtttggaagataaagctaaaagttcttatctttgcagtccgattcgcaaagaaaaggtgttacgcttttcttctttaccttctttccctttcgctaagagagcctgaaaaacgatagaaaaagaaaaacgaaaaaaaaacttccgaaaatatttggtagttaaaataaaacctcttacctttgcacccgcttttaaaacgaaagcaagatgttctttgaaatattgataaacaatacaagtagtacaagaaaaaaatagaaccgtcaatacttgtcttatatgtagtaatatgtatgagtcataaggtattaatgaagtcaataaattgtacggcatcctgaacagagcaaaaatcagctttatgctgactaacaatacttttacaatgaagagtttgatcctggctcag

SEQ ID NO: 512 - DNA, 58 bp, Artificial sequence
  Synthetic Sequence
gcaatggttaatctattgttaaaatttaaagtttcacttgaactttcaaataatgttc

What is claimed is:

1. A nucleic acid, comprising:
   (a) a promoter operable in a prokaryotic cell, wherein the promoter comprises a nucleotide sequence having 80% or more sequence identity with the nucleotide sequence: GTTAA $(n)_{3-7}$ GTTAA $(n)_{36-38}$ TA $(n)_2$ TTTG (SEQ ID NO: 400);
   wherein each n is independently selected from A, C, G, and T;
   and
   (b) a nucleotide sequence of interest that is operably linked to the promoter, wherein the nucleotide sequence of interest and the promoter are not found operably linked in nature.

2. The nucleic acid of claim 1, wherein the prokaryotic cell is a *Bacteroides* cell.

3. A nucleic acid, comprising:
   (a) a promoter operable in a prokaryotic cell, wherein the promoter is a φB124-14 phage promoter or a functional fragment thereof and comprises a nucleotide sequence comprising one or more of the following:
   (i) 80% or more sequence identity of defined nucleotides of the nucleotide sequence: GTTAA $(n)_{4-7}$ GTTAA $(n)_{34-38}$ TA $(n)_2$ TTTG,
   (ii) 80% or more sequence identity with a sequence set forth in any of SEQ ID NOs: 388 and 407,
   (iii) a nucleotide sequence comprising GTTAA $(n)_{4-7}$ GTTAA,
   (iv) a nucleotide sequence comprising GTTAA $(n)_{44-50}$ TA,
   (v) a nucleotide sequence comprising GTTAA $(n)_{48-54}$ TTTG,
   (vi) a nucleotide sequence comprising GTTAA $(n)_{36-38}$ TA,
   (vii) a nucleotide sequence comprising GTTAA $(n)_{40-42}$ TTTG,
   (viii) a nucleotide sequence comprising GTTAA $(n)_{3-7}$ GTTAA $(n)_{36-38}$ TA,
   (ix) a nucleotide sequence comprising GTTAA $(n)_{3-7}$ GTTAA $(n)_{40-42}$ TTTG,
   (x) a nucleotide sequence comprising GTTAA $(n)_{44-50}$ TA $(n)_2$ TTTG,
   (xi) a nucleotide sequence comprising GTTAA $(n)_{36-38}$ TA $(n)_2$ TTTG,
   (xii) a nucleotide sequence comprising GTTAA $(n)_{0-20}$ GTTAA $(n)_{10-60}$ TA $(n)_{0-10}$ TTTG,
   (xiii) a nucleotide sequence comprising TTAA $(n)_{0-10}$ TTAA $(n)_{30-50}$ TA $(n)_2$ TTTG,
   (xiv) a nucleotide sequence comprising GTTAA $(n)_{4-7}$ GTTAA $(n)_{36-39}$ TA $(n)_2$ TTTGC,
   (xv) a nucleotide sequence comprising GTTAA $(n)_{4-7}$ GTTAA $(n)_{36-39}$ TA $(n)_2$ TTTG,
   (xvi) a nucleotide sequence comprising GTTAA $(n)_{4-7}$ GTTAA $(n)_{34-38}$ TA $(n)_2$ TTTG,
   (xvii) a nucleotide sequence comprising GTTAA $(n)_{4-7}$ GTTAA $(n)_{36-38}$ TA $(n)_2$ TTTG,
   (xviii) a nucleotide sequence comprising GTTAA $(n)_{3-7}$ GTTAA $(n)_{36-38}$ TA $(n)_2$ TTTG,
   (xix) a nucleotide sequence comprising GTTAA $(n)_{4-7}$ GTTAA $(n)_{12-16}$ TTG $(n)_{18-22}$ TA $(n)_2$ TTTGC,
   (xx) a nucleotide sequence comprising GTTAA $(n)_{3-7}$ GTTAA $(n)_{12-16}$ TTG $(n)_{18-22}$ TA $(n)_2$ TTTG,
   (xxi) a nucleotide sequence comprising GTTAA $(n)_{4-8}$ GTTAA $(n)_{12-16}$ TTG $(n)_{18-22}$ TA $(n)_2$ TTTG, and
   (xxii) a nucleotide sequence comprising GTTAA $(n)_{4-7}$ GTTAA $(n)_{12-16}$ TTG $(n)_{18-22}$ TA $(n)_2$ TTTG,
   wherein each n is independently selected from A, C, G, and T; and
   (b) a nucleotide sequence of interest that is operably linked to the promoter, wherein the nucleotide sequence of interest and the promoter are not found operably linked in nature.

4. The nucleic acid of claim 1, wherein the promoter comprises the nucleotide sequence set forth in SEQ ID NO: 388.

5. The nucleic acid of claim 1, wherein the nucleotide sequence of interest comprises a transgene sequence that encodes a protein.

6. A prokaryotic cell comprising the nucleic acid of claim 1.

7. The prokaryotic cell of claim 6, wherein the nucleic acid is integrated into a chromosome of the prokaryotic cell.

8. The prokaryotic cell of claim 6, wherein the prokaryotic cell is a *Bacteroides* cell.

9. The prokaryotic cell of claim 6, wherein the prokaryotic cell is an *E. coli* cell.

10. A method of expressing a nucleic acid in a prokaryotic cell, the method comprising: introducing the nucleic acid of claim 1 into the prokaryotic cell.

11. A method of delivering a protein to an individual's gut, the method comprising: introducing, into an individual's gut, a *Bacteroides* cell comprising the nucleic acid of claim 1.

12. The nucleic acid of claim 1, wherein the promoter comprises the nucleotide sequence set forth in SEQ ID NO: 3.

13. The nucleic acid of claim 1, wherein the promoter comprises the nucleotide sequence set forth in SEQ ID NO: 4.

14. The nucleic acid of claim 1, wherein the promoter comprises the nucleotide sequence set forth in SEQ ID NO: 5.

15. The nucleic acid of claim 1, wherein the promoter comprises the nucleotide sequence set forth in SEQ ID NO: 6.

16. The nucleic acid of claim 1, wherein the promoter comprises the nucleotide sequence set forth in SEQ ID NO: 7.

17. The nucleic acid of claim 1, wherein the promoter comprises the nucleotide sequence set forth in SEQ ID NO: 8.

18. The nucleic acid of claim 1, wherein the promoter comprises the nucleotide sequence set forth in SEQ ID NO: 383.

19. The nucleic acid of claim 1, wherein the promoter comprises the nucleotide sequence set forth in SEQ ID NO: 384.

20. The nucleic acid of claim 1, wherein the promoter comprises the nucleotide sequence set forth in SEQ ID NO: 385.

21. The nucleic acid of claim 1, wherein the promoter comprises the nucleotide sequence set forth in SEQ ID NO: 386.

22. The nucleic acid of claim 1, wherein the promoter comprises the nucleotide sequence set forth in SEQ ID NO: 387.

23. The nucleic acid of claim 1, wherein the promoter comprises the nucleotide sequence set forth in SEQ ID NO: 393.

24. The nucleic acid of claim 1, wherein the promoter comprises the nucleotide sequence set forth in SEQ ID NO: 394.

25. The nucleic acid of claim 1, wherein the promoter comprises the nucleotide sequence set forth in SEQ ID NO: 397.

26. The nucleic acid of claim 1, wherein the promoter comprises the nucleotide sequence set forth in SEQ ID NO: 406.

27. The nucleic acid of claim 1, wherein the promoter comprises the nucleotide sequence set forth in SEQ ID NO: 407.

28. The nucleic acid of claim 1, wherein the promoter comprises the nucleotide sequence set forth in any one of SEQ ID NOs: 150-364.

29. The nucleic acid of claim 1, wherein the first n of SEQ ID NO: 400 is 3 nucleotides.

30. The nucleic acid of claim 1, wherein the first n of SEQ ID NO: 400 is 4 nucleotides.

31. The nucleic acid of claim 1, wherein the first n of SEQ ID NO: 400 is 5 nucleotides.

32. The nucleic acid of claim 1, wherein the first n of SEQ ID NO: 400 is 6 nucleotides.

33. The nucleic acid of claim 1, wherein the first n of SEQ ID NO: 400 is 7 nucleotides.

34. The nucleic acid of claim 1, wherein the second n of SEQ ID NO: 400 is 36 nucleotides.

35. The nucleic acid of claim 1, wherein the second n of SEQ ID NO: 400 is 37 nucleotides.

36. The nucleic acid of claim 1, wherein the second n of SEQ ID NO: 400 is 38 nucleotides.

37. The nucleic acid of claim 1, wherein the first n of SEQ ID NO: 400 is 4-6 nucleotides and the second n is 37 nucleotides.

38. The nucleic acid of claim 1, wherein the promoter comprises a nucleotide sequence having 85% or more sequence identity with the nucleotide sequence:

GTTAA $(n)_{3-7}$ GTTAA $(n)_{36-38}$ TA $(n)_2$ TTTG (SEQ ID NO: 400).

39. The nucleic acid of claim 38, wherein the first n of SEQ ID NO: 400 is 3 nucleotides.

40. The nucleic acid of claim 38, wherein the first n of SEQ ID NO: 400 is 4 nucleotides.

41. The nucleic acid of claim 38, wherein the first n of SEQ ID NO: 400 is 5 nucleotides.

42. The nucleic acid of claim 38, wherein the first n of SEQ ID NO: 400 is 6 nucleotides.

43. The nucleic acid of claim 38, wherein the first n of SEQ ID NO: 400 is 7 nucleotides.

44. The nucleic acid of claim 38, wherein the second n of SEQ ID NO: 400 is 36 nucleotides.

45. The nucleic acid of claim 38, wherein the second n of SEQ ID NO: 400 is 37 nucleotides.

46. The nucleic acid of claim 38, wherein the second n of SEQ ID NO: 400 is 38 nucleotides.

47. The nucleic acid of claim 38, wherein the first n of SEQ ID NO: 400 is 4-6 nucleotides and the second n is 37 nucleotides.

48. The nucleic acid of claim 1, wherein the promoter comprises a nucleotide sequence having 90% or more sequence identity with the nucleotide sequence:

GTTAA $(n)_{3-7}$ GTTAA $(n)_{36-38}$ TA $(n)_2$ TTTG (SEQ ID NO: 400).

49. The nucleic acid of claim 48, wherein the first n of SEQ ID NO: 400 is 3 nucleotides.

50. The nucleic acid of claim 48, wherein the first n of SEQ ID NO: 400 is 4 nucleotides.

51. The nucleic acid of claim 48, wherein the first n of SEQ ID NO: 400 is 5 nucleotides.

52. The nucleic acid of claim 48, wherein the first n of SEQ ID NO: 400 is 6 nucleotides.

53. The nucleic acid of claim 48, wherein the first n of SEQ ID NO: 400 is 7 nucleotides.

54. The nucleic acid of claim 48, wherein the second n of SEQ ID NO: 400 is 36 nucleotides.

55. The nucleic acid of claim 48, wherein the second n of SEQ ID NO: 400 is 37 nucleotides.

56. The nucleic acid of claim 48, wherein the second n of SEQ ID NO: 400 is 38 nucleotides.

57. The nucleic acid of claim 48, wherein the first n of SEQ ID NO: 400 is 4-6 nucleotides and the second n is 37 nucleotides.

58. The nucleic acid of claim 1, wherein the promoter comprises a nucleotide sequence having 95% or more sequence identity with the nucleotide sequence:
GTTAA $(n)_{3-7}$ GTTAA $(n)_{36-38}$ TA $(n)_2$ TTTG (SEQ ID NO: 400).

59. The nucleic acid of claim 58, wherein the first n of SEQ ID NO: 400 is 3 nucleotides.

60. The nucleic acid of claim 58, wherein the first n of SEQ ID NO: 400 is 4 nucleotides.

61. The nucleic acid of claim 58, wherein the first n of SEQ ID NO: 400 is 5 nucleotides.

62. The nucleic acid of claim 58, wherein the first n of SEQ ID NO: 400 is 6 nucleotides.

63. The nucleic acid of claim 58, wherein the first n of SEQ ID NO: 400 is 7 nucleotides.

64. The nucleic acid of claim 58, wherein the second n of SEQ ID NO: 400 is 36 nucleotides.

65. The nucleic acid of claim 58, wherein the second n of SEQ ID NO: 400 is 37 nucleotides.

66. The nucleic acid of claim 58, wherein the second n of SEQ ID NO: 400 is 38 nucleotides.

67. The nucleic acid of claim 58, wherein the first n of SEQ ID NO: 400 is 4-6 nucleotides and the second n is 37 nucleotides.

68. The nucleic acid of claim 1, wherein the promoter comprises the nucleotide sequence:
GTTAA $(n)_{3-7}$ GTTAA $(n)_{36-38}$ TA $(n)_2$ TTTG (SEQ ID NO: 400).

69. The nucleic acid of claim 68, wherein the first n of SEQ ID NO: 400 is 3 nucleotides.

70. The nucleic acid of claim 68, wherein the first n of SEQ ID NO: 400 is 4 nucleotides.

71. The nucleic acid of claim 68, wherein the first n of SEQ ID NO: 400 is 5 nucleotides.

72. The nucleic acid of claim 68, wherein the first n of SEQ ID NO: 400 is 6 nucleotides.

73. The nucleic acid of claim 68, wherein the first n of SEQ ID NO: 400 is 7 nucleotides.

74. The nucleic acid of claim 68, wherein the second n of SEQ ID NO: 400 is 36 nucleotides.

75. The nucleic acid of claim 68, wherein the second n of SEQ ID NO: 400 is 37 nucleotides.

76. The nucleic acid of claim 68, wherein the second n of SEQ ID NO: 400 is 38 nucleotides.

77. The nucleic acid of claim 68, wherein the first n of SEQ ID NO: 400 is 4-6 nucleotides and the second n is 37 nucleotides.

78. The nucleic acid of claim 1, further comprising a terminator sequence upstream of the promoter.

79. The nucleic acid of claim 78, wherein the terminator sequence comprises SEQ ID NO: 409.

* * * * *